(12) United States Patent
Ader et al.

(10) Patent No.: US 10,808,249 B2
(45) Date of Patent: Oct. 20, 2020

(54) METHODS AND COMPOSITIONS FOR WEED CONTROL

(75) Inventors: Daniel Ader, St. Louis, MO (US);
John J. Finnessy, Des Peres, MO (US);
Zhaolong Li, St. Charles, MO (US);
Hong Liu, St. Louis, MO (US); James D. Masucci, Manchester, MO (US);
Ronak Hasmukh Shah, Jamaica, NY (US); Nengbing Tao, O'Fallon, MO (US); Dafu Wang, Chesterfield, MO (US)

(73) Assignee: Monsanto Technology LLC, St. Louis, MO (US)

(*) Notice: Subject to any disclaimer, the term of this patent is extended or adjusted under 35 U.S.C. 154(b) by 808 days.

(21) Appl. No.: 13/612,954

(22) Filed: Sep. 13, 2012

(65) Prior Publication Data

US 2013/0254940 A1    Sep. 26, 2013

Related U.S. Application Data

(60) Provisional application No. 61/534,082, filed on Sep. 13, 2011.

(51) Int. Cl.
| | | |
|---|---|---|
| *C12N 15/82* | (2006.01) | |
| *C12N 15/113* | (2010.01) | |
| *C12N 9/02* | (2006.01) | |
| *A01N 43/58* | (2006.01) | |
| *A01N 57/16* | (2006.01) | |

(52) U.S. Cl.
CPC .......... *C12N 15/1137* (2013.01); *A01N 43/58* (2013.01); *A01N 57/16* (2013.01); *C12N 9/0004* (2013.01); *C12N 15/8274* (2013.01)

(58) Field of Classification Search
CPC .............................. C12N 15/113; A01N 57/16
See application file for complete search history.

(56) References Cited

U.S. PATENT DOCUMENTS

| | | | |
|---|---|---|---|
| 3,687,808 | A | 8/1972 | Merigan et al. |
| 3,791,932 | A | 2/1974 | Schuurs et al. |
| 3,839,153 | A | 10/1974 | Schuurs et al. |
| 3,850,578 | A | 11/1974 | McConnell |
| 3,850,752 | A | 11/1974 | Schuurs et al. |
| 3,853,987 | A | 12/1974 | Dreyer |
| 3,867,517 | A | 2/1975 | Ling |

(Continued)

FOREIGN PATENT DOCUMENTS

| | | |
|---|---|---|
| AU | 2008258254 B2 | 7/2014 |
| AU | 20 14262189 B2 | 11/2014 |

(Continued)

OTHER PUBLICATIONS

Street, 2008, http://biochemistryrevisited.blogspot.com/2008/01/why-is-dna-and-not-rna-stable-storage.html#!/2008/01/why-is-dna-and-not-rna-stable-storage.htm.*

(Continued)

*Primary Examiner* — Weihua Fan
(74) *Attorney, Agent, or Firm* — Arnold & Porter Kaye Scholer

(57) ABSTRACT

Provided are novel compositions for use to enhance weed control. Specifically, the present invention provides for methods and compositions that modulate Phytoene desaturase in weed species. The present invention also provides for combinations of compositions and methods that enhance weed control.

21 Claims, 2 Drawing Sheets

Specification includes a Sequence Listing.

ssDNA-PDS fb Norflurazon

(56) References Cited

U.S. PATENT DOCUMENTS

| | | |
|---|---|---|
| 3,879,262 A | 4/1975 | Schuurs et al. |
| 3,901,654 A | 8/1975 | Gross |
| 3,935,074 A | 1/1976 | Rubenstein et al. |
| 3,984,533 A | 10/1976 | Uzgiris |
| 3,996,345 A | 12/1976 | Ullman et al. |
| 4,034,074 A | 7/1977 | Miles |
| 4,098,876 A | 7/1978 | Piasio et al. |
| 4,469,863 A | 9/1984 | Ts'o et al. |
| 4,476,301 A | 10/1984 | Imbach et al. |
| 4,535,060 A | 8/1985 | Comai |
| 4,581,847 A | 4/1986 | Hibberd et al. |
| 4,666,828 A | 5/1987 | Gusella |
| 4,683,202 A | 7/1987 | Mullis |
| 4,761,373 A | 8/1988 | Anderson et al. |
| 4,769,061 A | 9/1988 | Comai |
| 4,801,531 A | 1/1989 | Frossard |
| 4,810,648 A | 3/1989 | Stalker |
| 4,879,219 A | 11/1989 | Wands et al. |
| 4,940,835 A | 7/1990 | Shah et al. |
| 4,971,908 A | 11/1990 | Kishore et al. |
| 5,004,863 A | 4/1991 | Umbeck |
| 5,011,771 A | 4/1991 | Bellet et al. |
| 5,013,659 A | 5/1991 | Bedbrook et al. |
| 5,015,580 A | 5/1991 | Christou et al. |
| 5,023,243 A | 6/1991 | Tullis |
| 5,034,506 A | 7/1991 | Summerton et al. |
| 5,094,945 A | 3/1992 | Comai |
| 5,141,870 A | 8/1992 | Bedbrook et al. |
| 5,145,783 A | 9/1992 | Kishore et al. |
| 5,159,135 A | 10/1992 | Umbeck |
| 5,166,315 A | 11/1992 | Summerton et al. |
| 5,177,196 A | 1/1993 | Meyer, Jr. et al. |
| 5,185,444 A | 2/1993 | Summerton et al. |
| 5,188,642 A | 2/1993 | Shah et al. |
| 5,188,897 A | 2/1993 | Suhadolnik et al. |
| 5,192,659 A | 3/1993 | Simons |
| 5,214,134 A | 5/1993 | Weis et al. |
| 5,216,141 A | 6/1993 | Benner |
| 5,235,033 A | 8/1993 | Summerton et al. |
| 5,264,423 A | 11/1993 | Cohen et al. |
| 5,264,562 A | 11/1993 | Matteucci |
| 5,264,564 A | 11/1993 | Matteucci |
| 5,272,057 A | 12/1993 | Smulson et al. |
| 5,276,019 A | 1/1994 | Cohen et al. |
| 5,281,521 A | 1/1994 | Trojanowski et al. |
| 5,286,634 A | 2/1994 | Stadler et al. |
| 5,286,717 A | 2/1994 | Cohen et al. |
| 5,304,732 A | 4/1994 | Anderson et al. |
| 5,310,667 A | 5/1994 | Eichholtz et al. |
| 5,312,910 A | 5/1994 | Kishore et al. |
| 5,321,131 A | 6/1994 | Agrawal et al. |
| 5,331,107 A | 7/1994 | Anderson et al. |
| 5,339,107 A | 8/1994 | Henry et al. |
| 5,346,107 A | 9/1994 | Bouix et al. |
| 5,378,824 A | 1/1995 | Bedbrook et al. |
| 5,384,253 A | 1/1995 | Krzyzek et al. |
| 5,390,667 A | 2/1995 | Kumakura et al. |
| 5,392,910 A | 2/1995 | Bell et al. |
| 5,393,175 A | 2/1995 | Courville |
| 5,399,676 A | 3/1995 | Froehler |
| 5,405,938 A | 4/1995 | Summerton et al. |
| 5,405,939 A | 4/1995 | Suhadolnik et al. |
| 5,416,011 A | 5/1995 | Hinchee et al. |
| 5,453,496 A | 9/1995 | Caruthers et al. |
| 5,455,233 A | 10/1995 | Spielvogel et al. |
| 5,459,127 A | 10/1995 | Felgner et al. |
| 5,460,667 A | 10/1995 | Moriyuki et al. |
| 5,462,910 A | 10/1995 | Ito et al. |
| 5,463,174 A | 10/1995 | Moloney et al. |
| 5,463,175 A | 10/1995 | Barry et al. |
| 5,466,677 A | 11/1995 | Baxter et al. |
| 5,470,967 A | 11/1995 | Huie et al. |
| 5,476,925 A | 12/1995 | Letsinger et al. |
| 5,489,520 A | 2/1996 | Adams et al. |
| 5,489,677 A | 2/1996 | Sanghvi et al. |
| 5,491,288 A | 2/1996 | Chaubet et al. |
| 5,510,471 A | 4/1996 | Lebrun et al. |
| 5,518,908 A | 5/1996 | Corbin et al. |
| 5,519,126 A | 5/1996 | Hecht |
| 5,536,821 A | 7/1996 | Agrawal et al. |
| 5,538,880 A | 7/1996 | Lundquist et al. |
| 5,541,306 A | 7/1996 | Agrawal et al. |
| 5,541,307 A | 7/1996 | Cook et al. |
| 5,550,111 A | 8/1996 | Suhadolnik et al. |
| 5,550,318 A | 8/1996 | Adams et al. |
| 5,550,398 A | 8/1996 | Kocian et al. |
| 5,550,468 A | 8/1996 | Häberlein et al. |
| 5,558,071 A | 9/1996 | Ward et al. |
| 5,561,225 A | 10/1996 | Maddry et al. |
| 5,561,236 A | 10/1996 | Leemans et al. |
| 5,563,253 A | 10/1996 | Agrawal et al. |
| 5,569,834 A | 10/1996 | Hinchee et al. |
| 5,571,799 A | 11/1996 | Tkachuk et al. |
| 5,587,361 A | 12/1996 | Cook et al. |
| 5,591,616 A | 1/1997 | Hiei et al. |
| 5,593,874 A | 1/1997 | Brown et al. |
| 5,596,086 A | 1/1997 | Matteucci et al. |
| 5,597,717 A | 1/1997 | Guerineau et al. |
| 5,602,240 A | 2/1997 | De Mesmaeker et al. |
| 5,605,011 A | 2/1997 | Bedbrook et al. |
| 5,608,046 A | 3/1997 | Cook et al. |
| 5,610,289 A | 3/1997 | Cook et al. |
| 5,618,704 A | 4/1997 | Sanghvi et al. |
| 5,623,070 A | 4/1997 | Cook et al. |
| 5,625,050 A | 4/1997 | Beaton et al. |
| 5,627,061 A | 5/1997 | Barry et al. |
| 5,633,360 A | 5/1997 | Bischofberger et al. |
| 5,633,435 A | 5/1997 | Barry et al. |
| 5,633,448 A | 5/1997 | Lebrun et al. |
| 5,639,024 A | 6/1997 | Mueller et al. |
| 5,646,024 A | 7/1997 | Leemans et al. |
| 5,648,477 A | 7/1997 | Leemans et al. |
| 5,663,312 A | 9/1997 | Chaturvedula |
| 5,677,437 A | 10/1997 | Teng et al. |
| 5,677,439 A | 10/1997 | Weis et al. |
| 5,719,046 A | 2/1998 | Guerineau et al. |
| 5,721,138 A | 2/1998 | Lawn |
| 5,731,180 A | 3/1998 | Dietrich |
| 5,739,180 A | 4/1998 | Taylor-Smith |
| 5,746,180 A | 5/1998 | Jefferson et al. |
| 5,767,361 A | 6/1998 | Dietrich |
| 5,767,373 A | 6/1998 | Ward et al. |
| 5,780,708 A | 7/1998 | Lundquist et al. |
| 5,804,425 A | 9/1998 | Barry et al. |
| 5,824,877 A | 10/1998 | Hinchee et al. |
| 5,837,848 A | 11/1998 | Ely et al. |
| 5,859,347 A | 1/1999 | Brown et al. |
| 5,866,775 A | 2/1999 | Eichholtz et al. |
| 5,874,265 A | 2/1999 | Adams et al. |
| 5,879,903 A | 3/1999 | Strauch et al. |
| 5,914,451 A | 6/1999 | Martinell et al. |
| 5,919,675 A | 7/1999 | Adams et al. |
| 5,928,937 A | 7/1999 | Kakefuda et al. |
| 5,939,602 A | 8/1999 | Volrath et al. |
| 5,969,213 A | 10/1999 | Adams et al. |
| 5,981,840 A | 11/1999 | Zhao et al. |
| 5,985,793 A * | 11/1999 | Sandbrink ............. A01N 43/40 504/363 |
| RE36,449 E | 12/1999 | Lebrun et al. |
| 6,040,497 A | 3/2000 | Spencer et al. |
| 6,056,938 A | 5/2000 | Unger et al. |
| 6,069,115 A | 5/2000 | Pallett et al. |
| 6,084,089 A | 7/2000 | Mine et al. |
| 6,084,155 A | 7/2000 | Volrath et al. |
| 6,118,047 A | 9/2000 | Anderson et al. |
| 6,121,513 A | 9/2000 | Zhang et al. |
| 6,130,366 A | 10/2000 | Herrera-Estrella et al. |
| 6,140,078 A | 10/2000 | Sanders et al. |
| 6,153,812 A | 11/2000 | Fry et al. |
| 6,160,208 A | 12/2000 | Lundquist et al. |
| 6,177,616 B1 | 1/2001 | Bartsch et al. |
| 6,194,636 B1 | 2/2001 | McElroy et al. |
| 6,225,105 B1 | 5/2001 | Sathasivan et al. |
| 6,225,114 B1 | 5/2001 | Eichholtz et al. |

(56) References Cited

U.S. PATENT DOCUMENTS

| | | |
|---|---|---|
| 6,232,526 B1 | 5/2001 | McElroy et al. |
| 6,245,968 B1 | 6/2001 | Boudec et al. |
| 6,248,876 B1 | 6/2001 | Barry et al. |
| 6,252,138 B1 | 6/2001 | Karimi et al. |
| RE37,287 E | 7/2001 | Lebrun et al. |
| 6,268,549 B1 | 7/2001 | Sailland et al. |
| 6,271,359 B1 | 8/2001 | Norris et al. |
| 6,282,837 B1 | 9/2001 | Ward et al. |
| 6,288,306 B1 | 9/2001 | Ward et al. |
| 6,288,312 B1 | 9/2001 | Christou et al. |
| 6,294,714 B1 | 9/2001 | Matsunaga et al. |
| 6,326,193 B1 | 12/2001 | Liu et al. |
| 6,329,571 B1 | 12/2001 | Hiei |
| 6,348,185 B1 | 2/2002 | Piwnica-Worms |
| 6,365,807 B1 | 4/2002 | Christou et al. |
| 6,384,301 B1 | 5/2002 | Martinell et al. |
| 6,385,902 B1 | 5/2002 | Schipper et al. |
| 6,399,861 B1 | 6/2002 | Anderson et al. |
| 6,403,865 B1 | 6/2002 | Koziel et al. |
| 6,414,222 B1 | 7/2002 | Gengenbach et al. |
| 6,421,956 B1 | 7/2002 | Boukens et al. |
| 6,426,446 B1 | 7/2002 | McElroy et al. |
| 6,433,252 B1 | 8/2002 | Kriz et al. |
| 6,437,217 B1 | 8/2002 | McElroy et al. |
| 6,453,609 B1 | 9/2002 | Soll et al. |
| 6,479,291 B2 * | 11/2002 | Kumagai .............. C07K 14/005 435/320.1 |
| 6,506,559 B1 | 1/2003 | Fire et al. |
| 6,506,599 B1 | 1/2003 | Yoon |
| 6,642,435 B1 | 11/2003 | Rafalski et al. |
| 6,644,341 B1 | 11/2003 | Chemo et al. |
| 6,645,914 B1 | 11/2003 | Woznica et al. |
| 6,768,044 B1 | 7/2004 | Boudec et al. |
| 6,992,237 B1 | 1/2006 | Habben et al. |
| 7,022,896 B1 | 4/2006 | Weeks et al. |
| 7,026,528 B2 | 4/2006 | Cheng et al. |
| RE39,247 E | 8/2006 | Barry et al. |
| 7,105,724 B2 | 9/2006 | Weeks et al. |
| 7,119,256 B2 | 10/2006 | Shimizu et al. |
| 7,138,564 B2 | 11/2006 | Tian et al. |
| 7,297,541 B2 | 11/2007 | Moshiri et al. |
| 7,304,209 B2 | 12/2007 | Zink et al. |
| 7,312,379 B2 | 12/2007 | Andrews et al. |
| 7,323,310 B2 | 1/2008 | Peters et al. |
| 7,371,927 B2 | 5/2008 | Yao et al. |
| 7,392,379 B2 | 6/2008 | Le Pennec et al. |
| 7,405,347 B2 | 7/2008 | Hammer et al. |
| 7,406,981 B2 | 8/2008 | Hemo et al. |
| 7,462,379 B2 | 12/2008 | Fukuda et al. |
| 7,485,777 B2 | 2/2009 | Nakajima et al. |
| 7,525,013 B2 | 4/2009 | Hildebrand et al. |
| 7,550,578 B2 | 6/2009 | Budworth et al. |
| 7,622,301 B2 | 11/2009 | Ren et al. |
| 7,657,299 B2 | 2/2010 | Huizenga et al. |
| 7,671,254 B2 | 3/2010 | Tranel et al. |
| 7,714,188 B2 | 5/2010 | Castle et al. |
| 7,738,626 B2 | 6/2010 | Weese et al. |
| 7,807,791 B2 | 10/2010 | Sekar et al. |
| 7,838,263 B2 | 11/2010 | Dam et al. |
| 7,838,733 B2 | 11/2010 | Wright et al. |
| 7,842,856 B2 | 11/2010 | Tranel et al. |
| 7,884,262 B2 | 2/2011 | Clemente et al. |
| 7,910,805 B2 | 3/2011 | Duck et al. |
| 7,935,869 B2 | 5/2011 | Pallett et al. |
| 7,943,819 B2 | 5/2011 | Baum et al. |
| 7,973,218 B2 | 7/2011 | McCutchen et al. |
| 8,090,164 B2 | 1/2012 | Bullitt et al. |
| 8,143,480 B2 | 3/2012 | Axtell et al. |
| 8,226,938 B1 | 7/2012 | Meikle et al. |
| 8,548,778 B1 | 10/2013 | Hart et al. |
| 8,554,490 B2 | 10/2013 | Tang et al. |
| 9,121,022 B2 * | 9/2015 | Sammons .............. A01N 63/02 |
| 9,422,557 B2 | 8/2016 | Ader |
| 9,445,603 B2 | 9/2016 | Baum et al. |
| 9,777,288 B2 | 10/2017 | Beattie et al. |
| 9,850,496 B2 | 12/2017 | Beattie et al. |
| 9,856,495 B2 | 10/2018 | Beattie et al. |
| 2001/0006797 A1 * | 7/2001 | Kumagai et al. ........... 435/69.1 |
| 2001/0042257 A1 | 11/2001 | Connor-Ward et al. |
| 2002/0069430 A1 | 6/2002 | Kiaska et al. |
| 2002/0106653 A1 | 8/2002 | Kurane et al. |
| 2002/0114784 A1 | 8/2002 | Li et al. |
| 2003/0150017 A1 | 8/2003 | Mesa et al. |
| 2003/0154508 A1 | 8/2003 | Stevens et al. |
| 2003/0167537 A1 | 9/2003 | Jiang |
| 2003/0221211 A1 | 11/2003 | Rottmann et al. |
| 2004/0029275 A1 | 2/2004 | Brown et al. |
| 2004/0053289 A1 | 3/2004 | Allen et al. |
| 2004/0055041 A1 | 3/2004 | Labate et al. |
| 2004/0072692 A1 | 4/2004 | Hoffman et al. |
| 2004/0082475 A1 | 4/2004 | Hoffman et al. |
| 2004/0123347 A1 | 6/2004 | Hinchey et al. |
| 2004/0126845 A1 | 7/2004 | Eenennaam et al. |
| 2004/0133944 A1 | 7/2004 | Hake et al. |
| 2004/0147475 A1 | 7/2004 | Li et al. |
| 2004/0177399 A1 | 9/2004 | Hammer et al. |
| 2004/0216189 A1 | 10/2004 | Houmard et al. |
| 2004/0244075 A1 | 12/2004 | Cal et al. |
| 2004/0250310 A1 | 12/2004 | Shukla et al. |
| 2005/0005319 A1 | 1/2005 | della-Cioppa et al. |
| 2005/0044591 A1 * | 2/2005 | Yao .............. C12N 9/90 800/287 |
| 2005/0215435 A1 | 9/2005 | Menges et al. |
| 2005/0223425 A1 | 10/2005 | Clinton et al. |
| 2005/0246784 A1 | 11/2005 | Plesch et al. |
| 2005/0250647 A1 * | 11/2005 | Hills .............. A01N 47/36 504/133 |
| 2005/0289664 A1 | 12/2005 | Moshiri et al. |
| 2006/0009358 A1 | 1/2006 | Kibler et al. |
| 2006/0021087 A1 | 1/2006 | Baum et al. |
| 2006/0040826 A1 | 2/2006 | Eaton et al. |
| 2006/0111241 A1 | 5/2006 | Gerwick, III et al. |
| 2006/0130172 A1 | 6/2006 | Whaley et al. |
| 2006/0135758 A1 | 6/2006 | Wu |
| 2006/0200878 A1 | 9/2006 | Lutfiyya et al. |
| 2006/0223708 A1 | 10/2006 | Hoffman et al. |
| 2006/0223709 A1 | 10/2006 | Helmke et al. |
| 2006/0247197 A1 | 11/2006 | Van De Craen et al. |
| 2006/0272049 A1 | 11/2006 | Waterhouse et al. |
| 2006/0276339 A1 | 12/2006 | Windsor et al. |
| 2007/0011775 A1 | 1/2007 | Allen et al. |
| 2007/0021360 A1 | 1/2007 | Nyce et al. |
| 2007/0050863 A1 | 3/2007 | Tranel et al. |
| 2007/0124836 A1 | 5/2007 | Baum et al. |
| 2007/0199095 A1 | 8/2007 | Allen et al. |
| 2007/0250947 A1 | 10/2007 | Boukharov et al. |
| 2007/0259785 A1 | 11/2007 | Heck et al. |
| 2007/0269815 A1 | 11/2007 | Rivory et al. |
| 2007/0281900 A1 | 12/2007 | Cui et al. |
| 2007/0300329 A1 | 12/2007 | Allen et al. |
| 2008/0022423 A1 | 1/2008 | Roberts et al. |
| 2008/0050342 A1 | 2/2008 | Fire et al. |
| 2008/0092256 A1 | 4/2008 | Kohn |
| 2008/0113351 A1 | 5/2008 | Naito et al. |
| 2008/0155716 A1 | 6/2008 | Sonnewald et al. |
| 2008/0214443 A1 | 9/2008 | Baum et al. |
| 2009/0011934 A1 | 1/2009 | Zawierucha et al. |
| 2009/0018016 A1 | 1/2009 | Duck et al. |
| 2009/0036311 A1 | 2/2009 | Witschel et al. |
| 2009/0054240 A1 | 2/2009 | Witschel et al. |
| 2009/0075921 A1 | 3/2009 | Ikegawa et al. |
| 2009/0094717 A1 | 4/2009 | Troukhan et al. |
| 2009/0098614 A1 | 4/2009 | Zamore et al. |
| 2009/0118214 A1 | 5/2009 | Paldi et al. |
| 2009/0137395 A1 | 5/2009 | Chicoine et al. |
| 2009/0144848 A1 | 6/2009 | Kovalic et al. |
| 2009/0165153 A1 | 6/2009 | Wang et al. |
| 2009/0165166 A1 | 6/2009 | Feng et al. |
| 2009/0205079 A1 | 8/2009 | Kumar et al. |
| 2009/0215628 A1 | 8/2009 | Witschel et al. |
| 2009/0285784 A1 | 11/2009 | Raemaekers et al. |
| 2009/0293148 A1 | 11/2009 | Ren et al. |
| 2009/0298787 A1 | 12/2009 | Raemaekers et al. |
| 2009/0306189 A1 | 12/2009 | Raemaekers et al. |

(56) References Cited

U.S. PATENT DOCUMENTS

| | | |
|---|---|---|
| 2009/0307803 A1 | 12/2009 | Baum et al. |
| 2010/0005551 A1 | 1/2010 | Roberts et al. |
| 2010/0048670 A1 | 2/2010 | Biard et al. |
| 2010/0068172 A1 | 3/2010 | Van De Craen |
| 2010/0071088 A1 | 3/2010 | Sela et al. |
| 2010/0099561 A1 | 4/2010 | Selby et al. |
| 2010/0100988 A1 | 4/2010 | Tranel et al. |
| 2010/0152443 A1 | 6/2010 | Hirai et al. |
| 2010/0154083 A1 | 6/2010 | Ross et al. |
| 2010/0192237 A1 | 7/2010 | Ren et al. |
| 2010/0247578 A1 | 9/2010 | Salama |
| 2010/0248373 A1 | 9/2010 | Baba et al. |
| 2011/0015084 A1 | 1/2011 | Christian et al. |
| 2011/0015284 A1 | 1/2011 | Dees et al. |
| 2011/0028412 A1 | 2/2011 | Cappello et al. |
| 2011/0035836 A1 | 2/2011 | Eudes et al. |
| 2011/0041400 A1 | 2/2011 | Trias Vila et al. |
| 2011/0053226 A1 | 3/2011 | Rohayem |
| 2011/0098180 A1 | 4/2011 | Michel et al. |
| 2011/0105327 A1 | 5/2011 | Nelson |
| 2011/0105329 A1 | 5/2011 | Song et al. |
| 2011/0112570 A1 | 5/2011 | Mannava et al. |
| 2011/0126310 A1 | 5/2011 | Feng et al. |
| 2011/0126311 A1 | 5/2011 | Velcheva et al. |
| 2011/0152339 A1 | 6/2011 | Brown et al. |
| 2011/0152346 A1 | 6/2011 | Karleson et al. |
| 2011/0152353 A1 | 6/2011 | Koizumi |
| 2011/0160082 A1 | 6/2011 | Woo et al. |
| 2011/0166022 A1 | 7/2011 | Israels et al. |
| 2011/0166023 A1 | 7/2011 | Nettleton-Hammond et al. |
| 2011/0171176 A1 | 7/2011 | Baas et al. |
| 2011/0171287 A1 | 7/2011 | Saarma et al. |
| 2011/0177949 A1 | 7/2011 | Krapp et al. |
| 2011/0185444 A1 | 7/2011 | Li et al. |
| 2011/0185445 A1 | 7/2011 | Bogner et al. |
| 2011/0191897 A1 | 8/2011 | Poree et al. |
| 2011/0201501 A1 | 8/2011 | Song et al. |
| 2011/0203013 A1 | 8/2011 | Peterson et al. |
| 2011/0296555 A1 | 12/2011 | Ivashuta et al. |
| 2011/0296556 A1 | 12/2011 | Sammons et al. |
| 2012/0036594 A1 | 2/2012 | Cardoza et al. |
| 2012/0107355 A1 | 5/2012 | Harris et al. |
| 2012/0108497 A1 | 5/2012 | Paldi et al. |
| 2012/0137387 A1 | 5/2012 | Baum et al. |
| 2012/0150048 A1 | 6/2012 | Kang et al. |
| 2012/0156784 A1 | 6/2012 | Adams, Jr. et al. |
| 2012/0157512 A1 | 6/2012 | Ben-Chanoch et al. |
| 2012/0164205 A1 | 6/2012 | Baum et al. |
| 2012/0174262 A1 | 7/2012 | Azhakanandam et al. |
| 2012/0185967 A1 | 7/2012 | Sela et al. |
| 2012/0198586 A1 | 8/2012 | Narva et al. |
| 2012/0230565 A1 | 9/2012 | Steinberg et al. |
| 2012/0258646 A1 | 10/2012 | Sela et al. |
| 2013/0003213 A1 | 1/2013 | Kabelac et al. |
| 2013/0041004 A1 | 2/2013 | Drager et al. |
| 2013/0047297 A1 | 2/2013 | Sammons et al. |
| 2013/0047298 A1 | 2/2013 | Tang |
| 2013/0060133 A1 | 3/2013 | Kassab et al. |
| 2013/0067618 A1 | 3/2013 | Ader et al. |
| 2013/0084243 A1 | 4/2013 | Goetsch et al. |
| 2013/0096073 A1 | 4/2013 | Sidelman |
| 2013/0097726 A1 | 4/2013 | Ader et al. |
| 2013/0212739 A1 | 8/2013 | Giritch et al. |
| 2013/0226003 A1 | 8/2013 | Edic et al. |
| 2013/0247247 A1 | 9/2013 | Ader et al. |
| 2013/0254941 A1 | 9/2013 | Ader et al. |
| 2013/0288895 A1 | 10/2013 | Ader et al. |
| 2013/0318657 A1 | 11/2013 | Avniel et al. |
| 2013/0318658 A1 | 11/2013 | Ader et al. |
| 2013/0324842 A1 | 12/2013 | Mittal et al. |
| 2013/0326731 A1 | 12/2013 | Ader et al. |
| 2014/0018241 A1 | 1/2014 | Sammons et al. |
| 2014/0057789 A1 | 2/2014 | Sammons et al. |
| 2014/0109258 A1 | 4/2014 | Van De Craen et al. |
| 2014/0230090 A1 | 8/2014 | Avniel et al. |
| 2014/0274712 A1 | 9/2014 | Finnessy et al. |
| 2014/0275208 A1 | 9/2014 | Hu et al. |
| 2014/0296503 A1 | 10/2014 | Avniel et al. |
| 2015/0096079 A1 | 4/2015 | Avniel et al. |
| 2015/0143580 A1 | 5/2015 | Beattie et al. |
| 2015/0159156 A1 | 6/2015 | Inberg et al. |
| 2015/0203867 A1 | 7/2015 | Beattie et al. |
| 2015/0240258 A1 | 8/2015 | Beattie et al. |
| 2016/0015035 A1 | 1/2016 | Tao |
| 2016/0029644 A1 | 2/2016 | Tao |

FOREIGN PATENT DOCUMENTS

| | | | | |
|---|---|---|---|---|
| CN | 101279950 A | 10/2008 | | |
| CN | 101279951 A | 10/2008 | | |
| CN | 101892247 A | 11/2010 | | |
| CN | 101914540 A | 12/2010 | | |
| CN | 201010248213 | * 12/2010 | ........... | C12N 15/113 |
| CN | 201010248213-8 | * 12/2010 | ........... | C12N 15/113 |
| CN | 102154364 A | 8/2011 | | |
| DE | 288618 A5 | 4/1991 | | |
| DE | 10000600 A1 | 7/2001 | | |
| DE | 10116399 A1 | 10/2002 | | |
| DE | 10256353 A1 | 6/2003 | | |
| DE | 10256354 A1 | 6/2003 | | |
| DE | 10256367 A1 | 6/2003 | | |
| DE | 10204951 A1 | 8/2003 | | |
| DE | 10234875 A1 | 2/2004 | | |
| DE | 10234876 A1 | 2/2004 | | |
| DE | 102004054666 A1 | 5/2006 | | |
| DE | 102005014638 A1 | 10/2006 | | |
| DE | 102005014906 A1 | 10/2006 | | |
| DE | 102007012168 A1 | 9/2008 | | |
| DE | 102010042866 A1 | 5/2011 | | |
| EP | 0 804 600 A1 | 11/1997 | | |
| EP | 1 155 615 A1 | 11/2001 | | |
| EP | 1 157 991 A2 | 11/2001 | | |
| EP | 1 238 586 A1 | 9/2002 | | |
| EP | 1 416 049 A1 | 5/2004 | | |
| EP | 1 496 123 A1 | 1/2005 | | |
| EP | 1 889 902 A1 | 2/2008 | | |
| EP | 1 964 919 A1 | 9/2008 | | |
| EP | 2 147 919 A1 | 1/2010 | | |
| EP | 2 160 098 B1 | 11/2010 | | |
| EP | 2 530 159 A1 | 3/2011 | | |
| EP | 2 305 813 A2 | 4/2011 | | |
| EP | 2 473 024 A2 | 7/2012 | | |
| EP | 2 545 182 A1 | 1/2013 | | |
| JP | 2001253874 A | 9/2001 | | |
| JP | 2002080454 A | 3/2002 | | |
| JP | 2002138075 A | 5/2002 | | |
| JP | 2002145707 A | 5/2002 | | |
| JP | 2002220389 A | 8/2002 | | |
| JP | 2003064059 A | 3/2003 | | |
| JP | 2003096059 A | 4/2003 | | |
| JP | 2004051628 A | 2/2004 | | |
| JP | 2004107228 A | 4/2004 | | |
| JP | 2005008583 A | 1/2005 | | |
| JP | 2005239675 A | 9/2005 | | |
| JP | 2005314407 A | 11/2005 | | |
| JP | 2006232824 A | 9/2006 | | |
| JP | 2006282552 A | 10/2006 | | |
| JP | 2007153847 A | 6/2007 | | |
| JP | 2007161701 A | 6/2007 | | |
| JP | 2007182404 A | 7/2007 | | |
| JP | 2008074840 A | 4/2008 | | |
| JP | 2008074841 A | 4/2008 | | |
| JP | 2008133207 A | 6/2008 | | |
| JP | 2008133218 A | 6/2008 | | |
| JP | 2008169121 A | 7/2008 | | |
| JP | 2009067739 A | 4/2009 | | |
| JP | 2009114128 A | 5/2009 | | |
| JP | 2009-508481 A | 6/2009 | | |
| JP | 2009126792 A | 6/2009 | | |
| JP | 2009137851 A | 6/2009 | | |
| JP | 2016-532440 A | 10/2015 | | |
| RU | 2 291 613 C1 | 1/2007 | | |
| RU | 2 337 529 C1 | 11/2008 | | |
| WO | WO 89/11789 A1 | 12/1989 | | |

(56) References Cited

FOREIGN PATENT DOCUMENTS

| | | |
|---|---|---|
| WO | WO 95/34659 A1 | 12/1995 |
| WO | WO 95/34668 A2 | 12/1995 |
| WO | WO 96/005721 A1 | 2/1996 |
| WO | WO 96/033270 A1 | 10/1996 |
| WO | WO 96/038567 A2 | 12/1996 |
| WO | WO 96/040964 A2 | 12/1996 |
| WO | WO 97/49816 A1 | 12/1997 |
| WO | WO 99/14348 A1 | 3/1999 |
| WO | WO 99/024585 A1 | 5/1999 |
| WO | WO 99/26467 A1 | 6/1999 |
| WO | WO 99/27116 A2 | 6/1999 |
| WO | WO 99/32619 A1 | 7/1999 |
| WO | WO 99/61631 A1 | 12/1999 |
| WO | WO 99/67367 A1 | 12/1999 |
| WO | WO 00/32757 A2 | 6/2000 |
| WO | WO 00/044914 A1 | 8/2000 |
| WO | WO 2001/007601 A2 | 2/2001 |
| WO | WO 2001/085970 A2 | 11/2001 |
| WO | WO 02/14472 A2 | 2/2002 |
| WO | WO 02/066660 A2 | 8/2002 |
| WO | WO 03/000679 A2 | 1/2003 |
| WO | WO 03/004649 | 1/2003 |
| WO | WO 03/006422 A1 | 1/2003 |
| WO | WO 2003/004649 A1 | 1/2003 |
| WO | WO 03/012052 A2 | 2/2003 |
| WO | WO 03/013247 A1 | 2/2003 |
| WO | WO 03/016308 A1 | 2/2003 |
| WO | WO 2003/014357 A1 | 2/2003 |
| WO | WO 03/020704 A1 | 3/2003 |
| WO | WO 03/022051 A1 | 3/2003 |
| WO | WO 03/022831 A1 | 3/2003 |
| WO | WO 03/022843 A1 | 3/2003 |
| WO | WO 03/029243 A2 | 4/2003 |
| WO | WO 03/037085 A1 | 5/2003 |
| WO | WO 03/037878 A1 | 5/2003 |
| WO | WO 03/045878 A2 | 6/2003 |
| WO | WO 03/050087 A2 | 6/2003 |
| WO | WO 03/051823 A1 | 6/2003 |
| WO | WO 03/051824 A1 | 6/2003 |
| WO | WO 03/051846 A2 | 6/2003 |
| WO | WO 03/064625 A2 | 8/2003 |
| WO | WO 03/076409 A1 | 9/2003 |
| WO | WO 03/077648 A2 | 9/2003 |
| WO | WO 03/087067 A1 | 10/2003 |
| WO | WO 03/090539 A1 | 11/2003 |
| WO | WO 03/091217 A1 | 11/2003 |
| WO | WO 03/093269 A2 | 11/2003 |
| WO | WO 03/104206 A2 | 12/2003 |
| WO | WO 2004/002947 A1 | 1/2004 |
| WO | WO 2004/002981 A2 | 1/2004 |
| WO | WO 2004/005485 A2 | 1/2004 |
| WO | WO 2004/009761 A2 | 1/2004 |
| WO | WO 2004/011429 A1 | 2/2004 |
| WO | WO 2004/022771 A2 | 3/2004 |
| WO | WO 2004/029060 A1 | 4/2004 |
| WO | WO 2004/035545 A2 | 4/2004 |
| WO | WO 2004/035563 A1 | 4/2004 |
| WO | WO 2004/035564 A1 | 4/2004 |
| WO | WO 2004/037787 A1 | 5/2004 |
| WO | WO 2004/049806 A1 | 6/2004 |
| WO | WO 2004/062351 A2 | 7/2004 |
| WO | WO 2004/067518 A1 | 8/2004 |
| WO | WO 2004/067527 A1 | 8/2004 |
| WO | WO 2004/074443 A2 | 9/2004 |
| WO | WO 2004/077950 A1 | 9/2004 |
| WO | WO 2005/000824 A1 | 1/2005 |
| WO | WO 2005/003362 A2 | 1/2005 |
| WO | WO 2005/007627 A1 | 1/2005 |
| WO | WO 2005/007860 A1 | 1/2005 |
| WO | WO 2005/040152 A1 | 5/2005 |
| WO | WO 2005/047233 A1 | 5/2005 |
| WO | WO 2005/047281 A1 | 5/2005 |
| WO | WO 2005/061443 A2 | 7/2005 |
| WO | WO 2005/061464 A1 | 7/2005 |
| WO | WO 2005/068434 A1 | 7/2005 |
| WO | WO 2005/070889 A1 | 8/2005 |
| WO | WO 2005/089551 A1 | 9/2005 |
| WO | WO 2005/095335 A1 | 10/2005 |
| WO | WO 2005/107437 A2 | 11/2005 |
| WO | WO 2005/110068 A2 | 11/2005 |
| WO | WO 2006/006569 A1 | 1/2006 |
| WO | WO 2006/024820 A1 | 3/2006 |
| WO | WO 2006/029828 A1 | 3/2006 |
| WO | WO 2006/029829 A1 | 3/2006 |
| WO | WO 2006/037945 A1 | 4/2006 |
| WO | WO 2006/050803 A1 | 5/2006 |
| WO | WO 2006/074400 A2 | 7/2006 |
| WO | WO 2006/090792 A1 | 8/2006 |
| WO | WO 2006/123088 A2 | 11/2006 |
| WO | WO 2006/125687 A1 | 11/2006 |
| WO | WO 2006/125688 A1 | 11/2006 |
| WO | WO 2006/132270 A1 | 12/2006 |
| WO | WO 2006/138638 A1 | 12/2006 |
| WO | WO 2007/003294 A1 | 1/2007 |
| WO | WO 2007/007316 A1 | 1/2007 |
| WO | WO 2007/024783 | 3/2007 |
| WO | WO 2007/026834 A1 | 3/2007 |
| WO | WO 2007/035650 A2 | 3/2007 |
| WO | WO 2007/038788 A2 | 4/2007 |
| WO | WO 2007/039454 A1 | 4/2007 |
| WO | WO 2007/050715 A2 | 5/2007 |
| WO | WO 2007/051462 A2 | 5/2007 |
| WO | WO 2007/070389 A2 | 6/2007 |
| WO | WO 2007/071900 A1 | 6/2007 |
| WO | WO 2007/074405 A2 | 7/2007 |
| WO | WO 2007/077201 A1 | 7/2007 |
| WO | WO 2007/077247 A1 | 7/2007 |
| WO | WO 2007/080126 A2 | 7/2007 |
| WO | WO 2007/080127 A2 | 7/2007 |
| WO | WO 2007/083193 A2 | 7/2007 |
| WO | WO 2007/096576 A1 | 8/2007 |
| WO | WO 2007/051462 A2 | 10/2007 |
| WO | WO 2007/119434 A1 | 10/2007 |
| WO | WO 2007/134984 A1 | 11/2007 |
| WO | WO 2008/007100 A2 | 1/2008 |
| WO | WO 2008/009908 A1 | 1/2008 |
| WO | WO 2008/029084 A1 | 3/2008 |
| WO | WO 2008/042231 A2 | 4/2008 |
| WO | WO 2008/059948 A1 | 5/2008 |
| WO | WO 2008/063203 A2 | 5/2008 |
| WO | WO 2008/071918 A1 | 6/2008 |
| WO | WO 2008/074991 A1 | 6/2008 |
| WO | WO 2008/084073 A1 | 7/2008 |
| WO | WO 2008/100426 A2 | 8/2008 |
| WO | WO 2008/102908 A1 | 8/2008 |
| WO | WO 2008/148223 A1 | 12/2008 |
| WO | WO 2008/152072 A2 | 12/2008 |
| WO | WO 2008/152073 A2 | 12/2008 |
| WO | WO 2009/000757 A1 | 12/2008 |
| WO | WO 2009/005297 A2 | 1/2009 |
| WO | WO 2009/029690 A1 | 3/2009 |
| WO | WO 2009/035150 A3 | 3/2009 |
| WO | WO 2009/037329 A2 | 3/2009 |
| WO | WO 2009/046384 A1 | 4/2009 |
| WO | WO 2009/060429 A2 | 5/2009 |
| WO | WO 2009/063180 A1 | 5/2009 |
| WO | WO 2009/068170 A2 | 6/2009 |
| WO | WO 2009/068171 A2 | 6/2009 |
| WO | WO 2009/086041 A1 | 7/2009 |
| WO | WO 2009/090401 A2 | 7/2009 |
| WO | WO 2009/090402 A2 | 7/2009 |
| WO | WO 2009/115788 A1 | 9/2009 |
| WO | WO 2009/116558 A1 | 9/2009 |
| WO | WO 2009/125401 A2 | 10/2009 |
| WO | WO 2009/144079 A1 | 12/2009 |
| WO | WO 2009/152995 A1 | 12/2009 |
| WO | WO 2009/153607 A1 | 12/2009 |
| WO | WO 2009/158258 A1 | 12/2009 |
| WO | WO 2010/012649 A1 | 2/2010 |
| WO | WO 2010/026989 A1 | 3/2010 |
| WO | WO 2010/034153 A1 | 4/2010 |
| WO | WO 2010/049270 A1 | 5/2010 |
| WO | WO 2010/049369 A1 | 5/2010 |
| WO | WO 2010/049405 A1 | 5/2010 |

(56) References Cited

FOREIGN PATENT DOCUMENTS

| | | |
|---|---|---|
| WO | WO 2010/049414 A1 | 5/2010 |
| WO | WO 2010/056519 A1 | 5/2010 |
| WO | WO 2010/063422 A1 | 6/2010 |
| WO | WO 2010/069802 A1 | 6/2010 |
| WO | WO 2010/078906 A2 | 7/2010 |
| WO | WO 2010/078912 A1 | 7/2010 |
| WO | WO 2010/093788 A2 | 8/2010 |
| WO | WO 2010/104217 A1 | 9/2010 |
| WO | WO 2010/108611 A1 | 9/2010 |
| WO | WO 2010/112826 A2 | 10/2010 |
| WO | WO 2010/116122 A2 | 10/2010 |
| WO | WO 2010/119906 A1 | 10/2010 |
| WO | WO 2010/130970 A1 | 11/2010 |
| WO | WO 2011/001434 A1 | 1/2011 |
| WO | WO 2011/003776 A2 | 1/2011 |
| WO | WO 2011/028836 A2 | 3/2011 |
| WO | WO 2011/035874 A1 | 3/2011 |
| WO | WO 2011/045796 A1 | 4/2011 |
| WO | WO 2011/065451 A1 | 6/2011 |
| WO | WO 2011/067745 A2 | 6/2011 |
| WO | WO 2011/075188 A1 | 6/2011 |
| WO | WO 2011/080674 A2 | 7/2011 |
| WO | WO 2011/112570 A1 | 9/2011 |
| WO | WO 2011/132127 A1 | 10/2011 |
| WO | WO 2012/001626 A1 | 1/2012 |
| WO | WO 2012/056401 A1 | 5/2012 |
| WO | WO 2012/092580 A2 | 7/2012 |
| WO | WO 2012/156342 A1 | 11/2012 |
| WO | WO 2012/164100 A2 | 12/2012 |
| WO | WO 2013/010691 A1 | 1/2013 |
| WO | WO 2013/025670 A1 | 2/2013 |
| WO | WO 2013/039990 A1 | 3/2013 |
| WO | WO 2013/040005 A1 | 3/2013 |
| WO | WO 2013/040021 A1 | 3/2013 |
| WO | WO 2013/040033 A1 | 3/2013 |
| WO | WO 2013/040049 A1 | 3/2013 |
| WO | WO 2013/040057 A1 | 3/2013 |
| WO | WO 2013/040116 A9 | 3/2013 |
| WO | WO 2013/040117 A9 | 3/2013 |
| WO | WO 2013/153553 A2 | 10/2013 |
| WO | WO 2013/175480 A1 | 11/2013 |
| WO | WO 2014/022739 A2 | 2/2014 |
| WO | WO 2014/106837 A2 | 7/2014 |
| WO | WO 2014/106838 A2 | 7/2014 |
| WO | WO 2014/151255 A1 | 9/2014 |
| WO | WO 2014/164761 A1 | 10/2014 |
| WO | WO 2014/164797 A1 | 10/2014 |
| WO | WO 2015/010026 A2 | 1/2015 |
| WO | WO 2015/200539 A1 | 12/2015 |

OTHER PUBLICATIONS

Dawson, William O., et al. "cDNA cloning of the complete genome of tobacco mosaic virus and production of infectious transcripts." Proceedings of the National Academy of Sciences 83.6 (1986): 1832-1836.*
GenBank Accession No. U87257.1 (available online in 1997).*
Wild carrot, by Noxious Weed Control Board (NWCB) of Washington State, published online in 2010, retrieved online from www.nwcb.wa.gov/detail.asp?weed=46.*
Wiesman, Zeev, et al. "Novel cationic vesicle platform derived from vernonia oil for efficient delivery of DNA through plant cuticle membranes." Journal of biotechnology 130.1 (2007): 85-94.*
Riggins, Chance W., et al. "Characterization of de novo transcriptome for waterhemp (*Amaranthus tuberculatus*) using GS-FLX 454 pyrosequencing and its application for studies of herbicide target-site genes." Pest management science 66.10 (2010): 1042-1052.*
Tank mixing benefit, NCSU, 2004, published online at http://www.ncagr.gov/agronomi/pdffiles/Tank_Mixing.pdf.*
Fernández, Victoria, and Thomas Eichert. "Uptake of hydrophilic solutes through plant leaves: current state of knowledge and perspectives of foliar fertilization." Critical Reviews in Plant Sciences 28.1-2 (2009): 36-68.), (Year: 2009).*

Riggins, Chance W., et al. "Characterization of de novo transcriptome for waterhemp (*Amaranthus tuberculatus*) using GS-FLX 454 pyrosequencing and its application for studies of herbicide target-site genes." Pest management science 66.10 (2010): 1042-1052. (Year: 2010).*
Tank mixing benefit, NCSU, 2004, published online at http://www.ncagr.gov/agronomi/pdffiles/Tank_Mixing.pdf (Year: 2004).*
Wang, C. J., and Z. Q. Liu. "Foliar uptake of pesticides—present status and future challenge." Pesticide Biochemistry and Physiology 87.1 (2007): 1-8. (Year: 2007).*
Alarcón-Reverte et al., "Resistance to ACCase-inhibiting herbicides in the weed *Lolium multiflorum*," *Comm. Appl. Biol. Sci.*, 73(4):899-902 (2008).
Amarzguioui et al., "An algorithm for selection of functional siRNA sequences," *Biochemical and Biophysical Research Communications*, 316:1050-1058 (2004).
Ambrus et al., "The Diverse Roles of RNA Helicases in RNAi," *Cell Cycle*, 8(21):3500-3505 (2009).
An et al., "Transient RNAi Induction against Endogenous Genes in *Arabidopsis* Protoplasts Using in Vitro-Prepared Double-Stranded RNA," *Biosci Biotechnol Biochem*, 69(2):415-418 (2005).
Andersson et al., "A novel selection system for potato transformation using a mutated AHAS gene," *Plant Cell Reports*, 22(4):261-267 (2003).
Anonymous, "A handbook for high-level expression and purification of 6xHis-tagged proteins," *The QUIexpressionist*, (2003).
Anonymous, "Agronomy Facts 37: Adjuvants for enhancing herbicide performance," n.p., 1-8, (Jan. 26, 2000), Web, (Jan. 21, 2014).
Anonymous, "Devgen, The mini-Monsanto," KBC Securities (2006).
Anonymous, "Do Monsanto have the next big thing?," *Austalian Herbicide Resistance Initiative (AHRI)*, (Apr. 23, 2013) Web. (Jan. 19, 2015).
Aoki et al., "In Vivo Transfer Efficiency of Antisense Oligonucleotides into the Myocardium Using HVJ-Liposome Method," *Biochem Biophys Res Commun*, 231:540-545 (1997).
Arpaia et al., "Production of transgenic eggplant (*Solanum melongena* L.) resistant to Colorado Potato Beetle (*Leptinotarsa decemlineata* Say)," (1997) *Theor. Appl. Genet.*, 95:329-334 (1997).
Artmymovich, "Using RNA interference to increase crop yield and decrease pest damage," *MMG 445 Basic Biotech.*, 5(1):7-12 (2009).
Australian Patent Examination report No. 1 dated Nov. 11, 2013, in Australian Application No. 2011224570.
Axtell et al., "A Two-Hit Trigger for siRNA Biogenesis in Plants," *Cell*, 127:565-577 (2006).
Baerson et al., "Glyphosate-Resistant Goosegrass. Identification of a Mutation in the Target Enzyme 5-Enolpyruvylshikimate-3-Phosphate Synthase," *Plant Physiol.*, 129(3):1265-1275 (2002).
Bannerjee et al., "Efficient production of transgenic potato (*S. tuberosum* L. ssp. *andigena*) plants via *Agrobacterium tumefaciens*-mediated transformation," *Plant Sci.*, 170:732 738 (2006).
Baulcombe, "RNA silencing and heritable epigenetic effects in tomato and *Arabidopsis*," Abstract 13$^{th}$ Annual Fall Symposium, Plant Genomes to Phenomes, Donald Danforth Plant Science Center, 28-30 (2011).
Bayer et al., "Programmable ligand-controlled riboregulators of eukaryotic gene expression," *Nature Biotechnol.*, 23(3):337-343 (2005).
Beal, et al., "Second Structural Motif for Recognition of DNA by Oligonucleotide-Directed Triple-Helix Formation," *Science*, 251:1360-1363 (1992).
Becker et al., "Fertile transgenic wheat from microprojectile bombardment of scutellar tissue," *The Plant Journal*, 5(2):299-307 (1994).
Bhargava et al., "Long double-stranded RNA-mediated RNA interference as a tool to achieve site-specific silencing of hypothalamic neuropeptides," *Brain Research Protocols*, 13:115-125 (2004).
Boletta et al., "High Efficient Non-Viral Gene Delivery to the Rat Kidney by Novel Polycationic Vectors," *J Am Soc. Nephrol.*, 7:1728 (1996).
Bolognesi et al., "Characterizing the Mechanism of Action of Double-Stranded RNA Activity against Western Corn Rootworm(*Diabrotica virgifera virgifera* LeConte)," *PLoS One* 7(10):e47534 (2012).

(56) References Cited

OTHER PUBLICATIONS

Bolter et al., "A chloroplastic inner envelope membrane protease is essential for plant development," *FEBS Letters*, 580:789-794 (2006).
Breaker et al., "A DNA enzyme with Mg2+-dependent RNA phosphoesterase activity," *Chemistry and Biology*, 2:655-660 (1995).
Brodersen et al., "The diversity of RNA silencing pathways in plants," *Trends in Genetics*, 22(5):268-280 (2006).
Busi et al., "Gene flow increases the initial frequency of herbicide resistance alleles in unselectedpopulations," *Agriculture, Ecosystems and Environments*, Elsevier, Amsterdam, NL, 142(3):403-409 (2011).
Butler et al., "Priming and re-drying improve the survival of mature seeds of *Digitalis purpurea* during storage," *Annals of Botany*, 103:1261-1270 (2009).
Bytebier et al., "T-DNA organization in tumor cultures and transgenic plants of the monocotyledon *Asparagus officinalis*," *Proc. Natl. Acad. Sci. U.S.A.*, 84:5345-5349 (1987).
Chabbouh et al., "Cucumber mosaic virus in artichoke," *FAO Plant Protection Bulletin*, 38:52-53 (1990).
Chakravarty et al., "Genetic Transformation in Potato: Approaches and Strategies," *Amer J Potato Res*, 84:301 311 (2007).
Chee et al., "Transformation of Soybean (*Glycine max*) by Infecting Germinating Seeds with *Agrobacterium tumefaciens*," *Plant Physiol.*, 91:1212-1218 (1989).
Chen et al., "In Vivo Analysis of the Role of atTic20 in Protein Import into Chloroplasts," *The Plant Cell*, 14:641-654 (2002).
Cheng et al., "Production of fertile transgenic peanut (*Arachis hypogaea* L.) plants using *Agrobacterium tumefaciens*," *Plant Cell Reports*, 15:653-657 (1996).
Chi et al., "The Function of RH22, a DEAD RNA Helicase, in the Biogenesis of the 50S Ribosomal Subunits of *Arabidopsis* Chloroplasts," *Plant Physiology*, 158:693-707 (2012).
Chinese Office Action dated Aug. 28, 2013 in Chinese Application No. 201180012795.2.
Clough et al., "Floral dip: a simplified method for Agrobacterium-mediated transformation of *Arabidopsis thaliana*," *The Plant Journal*, 16(6):735-743 (1998).
CN101914540 Patent Diclosure, "Introduction of RNA into plant by interference," (2010).
Colbourne et al., "The Ecoresponsive Genome of Daphnia pulex," *Science*, 331(6017):555-561 (2011).
Colombian Office Action dated Aug. 2, 2013 in Application No. 12 152898.
Colombian Office Action dated Feb. 21, 2014 in Application No. 12 152898.
Cooney et al., "Site-Specific Oligonucleotide Binding Represses Transcription of the Human c-myc Gene in Vitro," *Science*, 241:456-459 (1988).
Cost Action FA0806 progress report "Plant virus control employing RNA-based vaccines: A novel non-transgenic strategy" (2010).
Dalmay et al., "An RNA-Depenedent RNA Polymerase Gene in *Arabidopsis* is Required for Posttranscriptional Gene Silencing Mediated by a Transgene but Not by a Virus," *Cell*, 101:543-553 (2000).
Database EMBL CBIB Daphnia—XP-002732239 (2011).
Davidson et al., "Engineering regulatory RNAs," *TRENDS in Biotechnology*, 23(3):109-112 (2005).
De Block, et al. "Engineering herbicide resistance in plants by expression of a detoxifying enzyme," *EMBO J.* 6(9):2513-2519 (1987).
De Framond, "MINI-Ti: A New Vector Strategy for Plant Genetic Engineering," *Nature Biotechnology*, 1:262-269 (1983).
Della-Cioppa et al., "Import of a precursor protein into chloroplasts is inhibited by the herbicide glyphosate," *The EMBO Journal*, 7(5):1299-1305 (1988).
Diallo et al., "Long Endogenous dsRNAs Can Induce Complete Gene Silencing in Mammalian Cells and Primary Cultures," *Oligonucleotides*, 13:381-392 (2003).
Dietemann et al., "*Varroa destructor*: research avenues towards sustainable control," *Journal of Apicultural Research*, 51(1):125-132 (2012).
Du et al., "A systematic analysis of the silencing effects of an active siRNA at all single-nucleotide mismatched target sites," *Nucleic Acids Research*, 33(5):1671-1677 (2005).
Dunoyer et al., "Small RNA Duplexes Function as Mobile Silencing Signals Between Plant Cells," *Science*, 328:912-916 (2010).
Ellington et al., "In vitro selection of RNA molecules that bind specific ligands," *Nature*, 346:818-822 (1990).
Eurasian Office Action dated Feb. 24, 2014, in Application No. 201201264.
European Cooperation in the field of Scientific and Technical Research—Memorandum of Understanding for COST Action FA0806 (2008).
European Supplemental Search Report dated Oct. 8, 2013 in Application No. 11753916.3.
Extended European Search Report dated Jan. 21, 2015, in European Patent Application No. 12 832 415.9.
Extended European Search Report dated Jan. 29, 2015, in European Patent Application No. 12 831 567.8.
Extended European Search Report dated Feb. 2, 2015, in European Patent Application No. 12 830 932.5.
Extended European Search Report dated Feb. 3, 2015, in European Patent Application No. 12 831 945.6.
Extended European Search Report dated Feb. 27, 2015, in European Patent Application No. 12 832 160.1.
Extended European Search Report dated Mar. 3, 2015, in European Patent Application No. 12 831 166.9.
Extended European Search Report dated Mar. 17, 2015, in European Patent Application No. 12 831 684.1.
Partial Supplementary European Search Report dated Mar. 2, 2015, in European Patent Application No. 12 831 494.5.
Fire et al., "Potent and specific genetic interference by double-stranded RNA in *Caenorhabditis elegans*," *Nature*, 391:806-811 (1998).
First Examination Report dated Apr. 23, 2013, in New Zealand Patent Application No. 601784.
First Examination Report dated Jul. 28, 2014, in New Zealand Patent Application No. 627060.
Fukuhara et al., "Enigmatic Double-Stranded RNA in Japonica Rice," *Plant Molecular Biology*, 21:1121-1130 (1993).
Fukuhara et al., "The Unusual Structure of a Novel RNA Replicon in Rice," *The Journal of Biological Chemistry*, 270(30):18147-18149 (1995).
Fukuhara et al., "The wide distribution of endornaviruses, large double-stranded RNA replicons with plasmid-like properties," *Archives of Virology*, 151:995-1002 (2006).
Further Examination Report issued in New Zealand Patent Application No. 601784 dated May 16, 2014.
Gaines et al., "Gene amplification confers glyphosate resistance in *Amaranthus palmeri*," *Proc. Natl. Acad. Sci. USA*, 107(3):1029-1034 (2010).
Gallie et al., "Identification of the motifs within the tobacco mosaic virus 5'-leader responsible for enhancing translation," *Nucleic Acids Res.*, 20(17):4631-4638 (1992).
Gan et al., "Bacterially expressed dsRNA protects maize against SCMV infection," *Plant Cell Rep*, 11:1261-1268 (2010).
Gao et al., "Down-regulation of acetolactate synthase compromises 01-1-mediated resistance to powdery mildew in tomato," *BMC Plant Biology*, 14 (2014).
Garbian et al., "Bidirectional Transfer of RNAi between Honey Bee and *Varroa destructor*: *Varroa* Gene Silencing Reduces *Varroa* Population," 8(12):1-9:e1003035 (2012).
Ge et al., "Rapid vacuolar sequestration: the horseweed glyphosate resistance mechanism," *Pest Management Sci.*, 66:345-348 (2010).
GenBank Accession No. DY640489, PU2_plate27_F03 PU2 Prunus persica cDNA similar to expressed mRNA inferred from Prunus persica hypothetical domain/motif containing IPR011005:Dihydropteroate synthase-like, MRNA sequence (2006) [Retrieved on Feb. 4, 2013]. Retrieved from the internet <URL: http://www.ncbi.nlm.nih.gov/nucest/DY640489>.

(56) References Cited

OTHER PUBLICATIONS

GenBank Accession No. EU24568—"Amaranthus hypochondriacus acetolactate synthase (ALS) gene," (2007).
GenBank Accession No. FJ972198, Solanum lycopersicum cultivar Ailsa Craig dihydropterin pyrophosphokinase-dihydropteroate synthase (HPPK-DHPS) gene, complete cds (2010) [Retrieved on Nov. 26, 2012]. Retrieved from the internet ,URL: http://www.ncbi.nlm.nih.gov/nuccore/FJ972198>.
GenBank accession No. AY545657.1, published 2004.
GenBank accession No. GI:186478573, published Jan. 22, 2014.
GenEmbl FJ861243, published Feb. 3, 2010.
Gong et al., "Silencing of Rieske iron-sulfur protein using chemically synthesised siRNA as a potential biopesticide against Plutella xylostella," *Pest Manag Sci*, 67:514-520 (2011).
Gressel et al., "A strategy to provide long-term control of weedy rice while mitigating herbicide resistance transgene flow, and its potential use for other crops with related weeds," *Pest Manag Sci*, 65(7):723-731 (2009).
Gutensohn et al., "Functional analysis of the two *Arabidopsis* homologues of Toc34, a component of the chloroplast protein import apparatus," *The Plant Journal*, 23(6):771-783 (2000).
Haigh, "The Priming of Seeds: Investigation into a method of priming large quantities of seeds using salt solutions," Thesis submitted to Macquarie University (1983).
Hamilton et al., "Guidelines for the Identification and Characterization of Plant Viruses," *J. gen. Virol.*, 54:223-241 (1981).
Hamilton et al., "Two classes of short interfering RNA in RNA silencing," *EMBO J.*, 21(17):4671-4679 (2002).
Han et al., "Molecular Basis for the Recognition of Primary microRNAs by the Drosha-DGCR8 Complex," *Cell*, 125(5):887-901 (2006).
Hannon, "RNA interference," *Nature*,481:244-251 (2002).
Hardegree, "Drying and storage effects on germination of primed grass seeds," *Journal of Range Management*, 47(3):196-199 (1994).
Harrison et al., "Does Lowering Glutamine Synthetase Activity in Nodules Modigy Nitrogen Metabolism and Growth of *Lotus japonicus?,*" *Plant Physiology*, 133:253-262 (2003).
Herman et al., "A three-component dicamba O-demethylase from *Pseudomonas maltophilia*, strain DI-6: gene isolation, characterization, and heterologous expression," *J. Biol. Chem.*, 280: 24759-24767 (2005).
Hewezi et al., "Local infiltration of high- and low-molecular-weight RNA from silenced sunflower (*Helianthus annuus* L.) plants triggers post-transcriptional gene silencing in non-silenced plants," *Plant Biotechnology Journal*, 3:81-89 (2005).
Hidayat et al., "Enhanced Metabolism of Fluazifop Acid in a Biotype of *Digitaria sanguinalis* Resistant to the Herbicide Fluazifop-P-Butyl," *Pesticide Biochem. Physiol.*, 57:137-146 (1997).
Himber et al., "Transitivity-dependant and -independent cell-to-cell movement of RNA silencing," *The EMBO Journal*, 22(17):4523-4533 (2003).
Hirschberg et al., "Molecular Basis of Herbicide Resistance in *Amaranthus hybridus,*" *Science*, 222:1346-1349 (1983).
Hoekema et al., "A binary plant vector strategy based on separation of vir- and T-region of the *Agrobacterium tumefaciens* Ti-plasmid," *Nature*, 303:179-180 (1983).
Hofgen et al., "Repression of Acetolactate Synthase Activity through Antisense Inhibition: Molecular and Biochemical Analysis of Transgenic Potato (*Solanum tuberosum* L. cv Desiree) Plants," *Plant Physiol.*, 107(2):469-477 (1995).
Hsieh et al., "A library of siRNA duplexes targeting the phosphoinositide 3-kinase pathway: determinants of gene silencing for use in cell-based screens," *Nucleic Acids Res.*, 32(3):893-901 (2004).
Huesken et al., "Design of a genome-wide siRNA library using an artificial neural network," *Nature Biotechnology*, 23(8): 995-1001 (2005).
Hunter et al., "RNA Interference Strategy to suppress Psyllids & Leafhoppers," *International Plant and Animal Genome XIX*, 15-19 (2011).
Ichihara et al., "Thermodynamic instability of siRNA duplex is a prerequisite for dependable prediction of siRNA activities," *Nucleic Acids Res.*, 35(18):e123 (2007).
International Preliminary Report on Patentability dated Sep. 11, 2014, in International Application No. PCT/IL13/50447.
International Search Report and the Written Opinion dated May 10, 2011, in International Application No. PCT/US 11/27528.
International Search Report and the Written Opinion dated Feb. 25, 2013, in International Application No. PCT/US 12/54883.
International Search Report and the Written Opinion dated Feb. 27, 2013, in International Application No. PCT/US 12/54814.
International Search Report and the Written Opinion dated Feb. 27, 2013, in International Application No. PCT/US 12/54842.
International Search Report and the Written Opinion dated Feb. 27, 2013, in International Application No. PCT/US 12/54862.
International Search Report and the Written Opinion dated Feb. 27, 2013, in International Application No. PCT/US 12/54894.
International Search Report and the Written Opinion dated Feb. 27, 2013, in International Application No. PCT/US 12/54974.
International Search Report and the Written Opinion dated Feb. 27, 2013, in International Application No. PCT/US 12/54980.
International Search Report and the Written Opinion dated Oct. 1, 2013, in International Application No. PCT/IL2013/050447.
International Search Report and the Written Opinion dated Jul. 15, 2014, in International Application No. PCT/US2014/025305.
International Search Report and the Written Opinion dated Jul. 22, 2014, in International Application No. PCT/IL2013/051083.
International Search Report and the Written Opinion dated Jul. 22, 2014, in International Application No. PCT/IL2013/051085.
International Search Report and the Written Opinion dated Jul. 24, 2014, in International Application No. PCT/US2014/026036.
International Search Report and Written Opinion dated Aug. 25, 2014, in International Application No. PCT/US2014/023503.
International Search Report and Written Opinion dated Aug. 27, 2014, in International Application No. PCT/US2014/023409.
International Search Report and Written Opinion dated Feb. 23, 2015, in International Application No. PCT/US2014/063832.
International Search Report dated Mar. 12, 2013, in International Application No. PCT/US 12/54789.
Invitation to Pay Additional Fees dated May 6, 2014, in International Application No. PCT/IL2013/051083.
Invitation to Pay Additional Fees dated May 6, 2014, in International Application No. PCT/IL2013/051085.
Invitation to Pay Additional Fees dated Nov. 25, 2014, in International Application No. PCT/US2014/047204.
Isaacs et al., "Engineered riboregulators enable post-transcriptional control of gene expression," *Nature Biotechnology*, 22(7):841-847 (2004).
Ji et al., "Regulation of small RNA stability: methylation and beyond," *Cell Research*, 22:624-636 (2012).
Jones-Rhoades et al., "MicroRNAs and Their Regulatory Roles in Plants," *Annu. Rev. Plant Biol.*, 57:19-53 (2006).
Josse et al., "A DELLA in Disguise: SPATULA Restrains the Growth of the Developing *Arabidopsis* Seedling," *Plant Cell*, 23:1337-1351 (2011).
Kam et al., "Nanotube Molecular Transporters: Internalization of Carbon Nanotube-Protein Conjugates into Mammalian Cells," *J. Am. Chem. Soc.*, 126(22):6850-6851 (2004).
Katoh et al., "Specific residues at every third position of siRNA shape its efficient RNAi activity," *Nucleic Acids Res.*, 35(4): e27 (2007).
Kertbundit et al., "In vivo random β-glucuronidase gene fusions in *Arabidopsis thaliana,*" *Proc. Natl. Acad. Sci. USA.*, 88:5212-5216 (1991).
Khachigian, "DNAzymes: Cutting a path to a new class of therapeutics," *Curr Opin Mol Ther* 4(2):119-121 (2002).
Khodakovskaya et al., "Carbon Nanotubes are Able to Penetrate Plant Seed Coat and Dramatically Affect Seed Germination and Plant Growth," *ACS Nano*, 3(10):3221-3227 (2009).
Kirkwood, "Use and Mode of Action of Adjuvants for Herbicides: A Review of some Current Work," *Pestic Sci.*, 38:93-102 (1993).

(56) References Cited

OTHER PUBLICATIONS

Klahre et al., "High molecular weight RNAs and small interfering RNAs induce systemic posttranscriptional gene silencing in plants," *Proc. Natl. Acad. Sci. USA*, PNAS, 99(18):11981-11986 (2002).
Kronenwett et al., "Oligodeoxyribonucleotide Uptake in Primary Human Hematopoietic Cells is Enhanced by Cationic Lipids and Depends on the Hematopoietic Cell Subset," *Blood*, 91(3):852-862 (1998).
Kumar et al., "Sequencing, De Novo Assembly and Annotation of the Colorado Potato Beetle, *Leptinotarsa decemlineata*,Transcriptome," *PLoS One*, 9(1):e86012 (2014).
Kusaba et al., "*Low glutelin content1*: A Dominant Mutation That Suppresses the *Glutelin* Multigene Family via RNA Silencing ni Rice," *The Plant Cell*, 15(6):1455-1467 (2003).
Kusaba, "RNA interference in crop plants," *Curr Opin Biotechnol*, 15(2):139-143 (2004).
Lavigne et al., "Enhanced antisense inhibition of human immunodeficiency virus type 1 in cell cultures by DLS delivery system," *Biochem Biophys Res Commun*, 237:566-571 (1997).
Lee et al., "Aptamer Database," *Nucleic Acids Research*, 32:D95-D100 (2004).
Lermontova et al., "Reduced activity of plastid protoporphyrinogen oxidase causes attenuated photodynamic damage during high-light compared to low-light exposure," *The Plant Journal*, 48(4):499-510 (2006).
Lesnik et al., "Prediction of rho-independent transcriptional terminators in *Escherichia coli*," *Nucleic Acids Research*, 29(17):3583-3594 (2001).
Li et al., "Establishment of a highly efficient transformation system for pepper (*Capsicum annuum* L.)," *Plant Cell Reports*, 21: 785-788 (2003).
Li et al., "The FAST technique: a simplified Agrobacterium-based transformation method for transient gene expression analysis in seedlings of *Arabidopsis* and other plant species," *Plant Methods*, 5(6):1-15 (2009).
Liu et al., "Carbon Nanotubes as Molecular Transporters for Walled Plant Cells," *Nano Letters*, 9(3):1007-1010 (2009).
Liu et al., "Comparative study on the interaction of DNA with three different kinds of surfactants and the formation of multilayer films," *Bioelectrochemistry*, 70:301-307 (2007).
Liu et al., "DNAzyme-mediated recovery of small recombinant RNAs from a 5S rRNA-derived chimera expressed in *Escherichia coli*," *BMC Biotechnology*, 10:85 (2010).
Llave et al., "Endogenous and Silencing-Associated Small RNAs in Plants," *The Plant Cell*, 14:1605-1619 (2002).
Lu et al., "RNA silencing in plants by the expression of siRNA duplexes," *Nucleic Acids Res.*, 32(21):e171 (2004).
Lu et al., "OligoWalk: an online siRNA design tool utilizing hybridization thermodynamics," *Nucleic Acids Research*, 36:W104-W108 (2008).
Luft, "Making sense out of antisense oligodeoxynucleotide delivery: getting there is half the fun," *J Mol Med*, 76:75-76 (1998).
Maas et al., "Mechanism and optimized conditions for PEG mediated DNA transfection into plant protoplasts," *Plant Cell Reports*, 8:148-149 (1989).
Maher III et al., "Inhibition of DNA binding proteins by oligonucleotide-directed triple helix formation," *Science*, 245(4919):725-730 (1989).
Makkouk et al., "Virus Diseases of Peas, Beans, and Faba Bean in the Mediterranean region," *Adv Virus Res*, 84:367-402 (2012).
Mandal et al., "Adenine riboswitches and gene activation by disruption of a transcription terminator," *Nature Struct. Mol. Biol.*, 11(1):29-35 (2004).
Mandal et al., "Gene Regulation by Riboswitches," *Nature Reviews | Molecular Cell Biology*, 5:451-463 (2004).
Manoharan, "Oligonucleotide Conjugates as Potential Antisense Drugs with Improved Uptake, Biodistribution, Targeted Delivery, and Mechanism of Action," *Antisense & Nucleic Acid Drug Development*, 12:103-128 (2002).
Masoud et al., "Constitutive expression of an inducible β-1,3-glucanase in alfalfa reduces disease severity caused by the oomycete pathogen *Phytophthora megasperma* f. sp *medicaginis*, but does not reduce disease severity of chitincontaining fungi," *Transgenic Research*, 5:313-323 (1996).
Matveeva et al., "Prediction of antisense oligonucleotide efficacy by in vitro methods," *Nature Biotechnology*, 16:1374-1375 (1998).
Meinke, et al., "Identifying essential genes in *Arabidopsis thaliana*," *Trends Plant Sci.*, 13(9):483-491 (2008).
Meins et al., "RNA Silencing Systems and Their Relevance to Plant Development," *Annu. Rev. Cell Dev. Biol.*, 21:297-318 (2005).
Melnyk et al., "Intercellular and systemic movement of RNA silencing signals," *The EMBO Journal*, 30:3553-3563 (2011).
Misawa et al., "Functional expression of the *Erwinia uredovora* carotenoid biosynthesis gene crtI in transgenic plants showing an increase of β-carotene biosynthesis activity and resistance to the bleaching herbicide norflurazon," *The Plant Journal*, 4(5):833-840 (1993).
Misawa et al., "Expression of an *Erwinia* phytoene desaturase gene not only confers multiple resistance to herbicides interfering with carotenoid biosynthesis but also alters xanthophyll metabolism in transgenic plants," *The Plant Journal*, 6(4):481-489 (1994).
Miura et al., "The Balance between Protein Synthesis and Degradation in Chloroplasts Determines Leaf Variegation in *Arabidopsis yellow variegated* Mutants," *The Plant Cell*, 19:1313-1328 (2007).
Molnar et al., "Plant Virus-Derived Small Interfering RNAs Originate redominantly from Highly Structured Single-Stranded Viral RNAs," *Journal of Virology*, 79(12):7812-7818 (2005).
Molnar et al., "Small Silencing RNAs in Plants are Mobile and Direct Epigenetic Modification in Recipient Cells," *Science*, 328:872-875 (2010).
Moriyama et al., "Double-stranded RNA in rice: a novel RNA replicon in plants," *Molecular & General Genetics*, 248(3):364-369 (1995).
Moriyama et al., "Stringently and developmentally regulated levels of a cytoplasmic double-stranded RNA and its high-efficiency transmission via egg and pollen in rice," *Plant Molecular Biology*, 31:713-719 (1996).
Morrissey et al., "Potent and persistent in vivo anti-HBV activity of chemically modified siRNAs," *Nat Biotechnol.* 23(8):1002-1007 (2005).
Moser et al., "Sequence-Specific Cleavage of Double Helical DNA by Triple Helix Formation," *Science*, 238:645-646 (1987).
Nowak et al., "A new and efficient method for inhibition of RNA viruses by DNA interference," *The FEBS Journal*, 276:4372-4380 (2009).
Office Action dated Feb. 17, 2014, in Mexican Patent Application No. MX/a/2012/010479.
Office Action dated Jan. 6, 2015, in Japanese Patent Application No. 2012-557165.
Office Action dated Nov. 19, 2014, in Eurasian Patent Application No. 201201264/28.
Ongvarrasopone et al., "A Simple and Cost Effective Method to Generate dsRNA for RNAi Studies in Invertebrates," *Science Asia*, 33:35-39 (2007).
Ouellet et al., "Members of the Acetohydroxyacid Synthase Muligene Family of *Brassica napus* Have Divergent Patterns of Expression," *The Plant Journal*, Blackwell Scientific Publications, Oxford, GB, 2(3):321-330 (1992).
Paddison et al., "Stable suppression of gene expression by RNAi in mammalian cells," *Proc. Natl Acad. Sci. USA*, 99(3):1443-1448 (2002).
Palauqui et al., "Activation of systemic acquired silencing by localised introduction of DNA," *Current Biology*, 9:59-66 (1999).
Parera et al., "Dehydration Rate after Solid Matrix Priming Alters Seed Performance of *Shrunken*-2 Corn," *J. Amer. Soc. Hort. Sci.*, 119(3):629-635 (1994).
Paungfoo-Lonhienne et al., "DNA is Taken up by Root Hairs and Pollen, and Stimulates Root and Pollen Tube Growth," *Plant Physiology*, 153:799-805 (2010).
Paungfoo-Lonhienne et al., "DNA uptake by *Arabidopsis* induces changes in the expression of CLE peptides which control root morphology," *Plant Signaling & Behavior*, 5(9):1112-1114 (2010).
Pei et al., "On the art of identifying effective and specific siRNAs," *Nature Methods*, 3(9):670-676 (2006).

(56) References Cited

OTHER PUBLICATIONS

Peretz et al., "A Universal Expression/Silencing Vector in Plants," *Plant Physiology*, 145:1251-1263 (2007).
Pornprom et al., "Glutamine synthetase mutation conferring target-site-based resistance to glufosinate in soybean cell selections," *Pest Manag Sci*, 2009; 65(2):216-222 (2009).
Preston et al., "Multiple effects of a naturally occurring proline to threonine substitution within acetolactate synthase in two herbicide-resistant populations of *Lactuca serriola*," *Pesticide Biochem. Physiol.*, 84(3):227-235 (2006).
Qiwei,"Advance in DNA interference," *Progress in Veterinary Medicine*, 30(1):71-75 (2009).
Rajur et al., "Covalent Protein—Oligonucleotide Conjugates for Efficient Delivery of Antisense Molecules," *Bioconjug Chem.*, 8:935-940 (1997).
Reddy et al., "Organosilicone Adjuvants Increased the Efficacy of Glyphosate for Control of Weeds in Citrus (*Citrus* spp.)" *HortScience* 27(9):1003-1005 (1992).
Reddy et al., "Aminomethylphosphonic Acid Accumulation in Plant Species Treated with Glyphosate," *J. Agric. Food Chem.*, 56(6):2125-2130 (2008).
Reither et al., "Specificity of DNA triple helix formation analyzed by a FRET assay," *BMC Biochemistry*, 3:27 (2002).
Rey et al., "Diversity of Dicotyledenous-Infecting Geminiviruses and Their Associated DNA Molecules in Southern Africa, Including the South-West Indian Ocean Islands," *Viruses*, 4:1753-1791 (2012).
Reynolds et al., "Rational siRNA design for RNA interference," *Nature Biotechnology*, 22:326-330 (2004).
Ryabov et al., "Cell-to-Cell, but Not Long-Distance, Spread of RNA Silencing That is Induced in Individual Epidermal Cells," *Journal of Virology*, 78(6):3149-3154 (2004).
Ryan, "Human endogenous retroviruses in health and disease: a symbiotic perspective," *Journal of the Royal Society of Medicine*, 97:560-565 (2004).
Santoro et al., "A general purpose RNA-cleaving DNA enzyme," *Proc. Natl. Acad. Sci. USA*, 94:4262-4266 (1997).
Sathasivan et al., "Nucleotide sequence of a mutant acetolactate synthase gene from an imidazolinone-resistant *Arabidopsis thaliana* var. Columbia," *Nucleic Acids Research*, 18(8):2188-2193 (1990).
Schwab et al., "RNA silencing amplification in plants: Size matters," *PNAS*, 107(34):14945-14946 (2010).
Schwember et al., "Drying Rates following Priming Affect Temperature Sensitivity of Germination and Longevity of Lettuce Seeds," *HortScience*, 40(3):778-781 (2005).
Second Chinese Office Action issued in Chinese Patent Application No. 201180012795.2, dated Jun. 10, 2014.
Seidman et al., "The potential for gene repair via triple helix formation," *J Clin Invest.*, 112(4):487-494 (2003).
Selvarani et al., "Evaluation of seed priming methods to improve seed vigour of onion (*Allium cepa cv. Aggregatum*) and carrot (*Daucus carota*)," *Journal of Agricultural Technology*, 7(3):857-867 (2011).
Sharma et al., "A simple and efficient *Agrobacterium*-mediated procedure for transformation of tomato," *J Biosci.*, 34(3):423 433 (2009).
Sijen et al., "On the Role of RNA Amplification in dsRNA-Triggered Gene Silencing," *Cell*, 107:465-476 (2001).
Silwet L-77 Spray Adjuvant for agricultural applications, product description from Momentive Performance Materials, Inc. (2003).
Singh et al., "Absorption and translocation of glyphosate with conventional and organosilicone adjuvants," *Weed Biology and Management*, 8:104-111 (2008).
Steeves et al., "Transgenic soybeans expressing siRNAs specific to a major sperm protein gene suppress *Heterodera glycines* reproduction," *Funct. Plant Biol.*, 33:991-999 (2006).
Stock et al., "Possible Mechanisms for Surfactant-Induced Foliar Uptake of Agrochemicals," *Pestic. Sci.*, 38:165-177 (1993).
Strat et al., "Specific and nontoxic silencing in mammalian cells with expressed long dsRNAs," *Nucleic Acids Research*, 34(13):3803-3810 (2006).

Sudarsan et al., "Metabolite-binding RNA domains are present in the genes of eukaryotes," *RNA*, 9:644-647 (2003).
Sun et al., "Antisense oligodeoxynucleotide inhibition as a potent strategy in plant biology: identification of SUSIBA2 as a transcriptional activator in plant sugar signalling," *The Plant Journal*, 44:128-138 (2005).
Sun et al., "A Highly efficient Transformation Protocol for Micro-Tom, a Model Cultivar for Tomato Functional Genomics," *Plant Cell Physiol.*, 47(3):426-431 (2006).
Sun et al., "Sweet delivery—sugar translocators as ports of entry for antisense oligodeoxynucleotides in plant cells," *The Plant Journal*, 52:1192-1198 (2007).
Takasaki et al., "An Effective Method for Selecting siRNA Target Sequences in Mammalian Cells," *Cell Cycle*, 3:790-795 (2004).
Temple et al., "Can glutamine synthetase activity levels be modulated in transgenic plants by the use of recombinant DNA technology?" *Transgenic Plants and Plant Biochemistry*, 22:915-920 (1994).
Temple et al., "Down-regulation of specific members of the glutamine synthetase gene family in Alfalfa by antisense RNA technology," *Plant Molecular Biology*, 37:535-547 (1998).
Templeton et al., "Improved DNA: liposome complexes for increased systemic delivery and gene expression," *Nature Biotechnology*, 15:647-652 (1997).
Tenllado et al., "Crude extracts of bacterially expressed dsRNA can be used to protect plants against virus infection," *BMC Biotechnology*, 3(3):1-11 (2003).
Tenllado et al., "RNA interference as a new biotechnological tool for the control of virus diseases in plants," *Virus Research*, 102:85-96 (2004).
Tepfer, "Risk assessment of virus resistant transgenic plants," *Annual Review of Phytopathology*, 40:467-491 (2002).
The Seed Biology Place, Website Gerhard Leubner Lab Royal Holloway, University of London, <http://www.seedbiology.de/seedtechnology.asp.
Third Party Submission filed on Nov. 29, 2012 in U.S. Appl. No. 13/042,856.
Thompson, et al., "CLUSTAL W: improving the sensitivity of progressive multiple sequence alignment through sequence weighting, position-specific gap penalties and weight matrix choice," *Nucl. Acids Res.*, 22(22):4673-4680 (1994).
Timmons et al., "Specific interference by ingested dsRNA," *Nature*, 395:854 (1998).
Tomari et al., "Perspective: machines for RNAi," *Genes & Dev.*, 19:517-529 (2005).
Töpfer et al., "Uptake and Transient Expression of Chimeric Genes in Seed-Derived Embryos," *Plant Cell*, 1:133-139 (1989).
Tran et al., "Control of specific gene expression in mammalian cells by co-expression of long complementary RNAs," *FEBS Lett.*;573(1-3):127-134 (2004).
Turina et al., "Tospoviruses in the Mediterranean Area," *Advances in Virus Research*, 84:403-437 (2012).
Tuschl, "RNA Interference and Small Interfering RNAs," *ChemBiochem.* 2(4):239-245 (2001).
Tuschl, "Expanding small RNA interference," *Nature Biotechnol.*, 20: 446-448 (2002).
Ui-Tei et al., "Guidelines for the selection of highly effective siRNA sequences for mammalian and chick RNA interference," *Nucleic Acids Res.*, 32(3): 936-948 (2004).
Unnamalai et al., "Cationic oligopeptide-mediated delivery of dsRNA for post-transcriptional gene silencing in plant cells," *FEBS Letters*, 566:307-310 (2004).
Unniraman et al., "Alternate Paradigm for Intrinsic Transcription Termination in Eubacteria," *The Journal of Biological Chemistry*, 276(45)(9):41850-41855 (2001).
Urayama et al., "Knock-down of *OsDCL2* in Rice Negatively Affects Maintenance of the Endogenous dsRNA Virus, *Oryza sativa* Endornavirus," *Plant and Cell Physiology*, 51(1):58-67 (2010).
Van de Wetering et al., "Specific inhibition of gene expression using a stably integrated, inducible small-interfering-RNA vector," *EMBO Rep.*, 4(6):609-615 (2003).
Vasil et al., "Herbicide Resistant Fertile Transgenic Wheat Plants Obtained by Microprojectile Bombardment of Regenerable Embryogenic Callus," *Bio/Technology*,10:667-674 (1992).

(56) References Cited

OTHER PUBLICATIONS

Vaucheret, "Post-transcriptional small RNA pathways in plants: mechanisms and regulations," *Genes Dev.*, 20:759-771 (2006).
Vencill et al., "Resistance of Weeds to Herbicides," *Herbicides and Environment*, 29:585-594 (2011).
Verma et al., "Modified oligonucleotides: synthesis and strategy for users," *Annu. Rev. Biochem.*, 67:99-134 (1998).
Vert et al., "An accurate and interpretable model for siRNA efficacy prediction," *BMC Bioinformatics*, 7:520 (2006).
Vionnet et al., "Systemic Spread of Sequence-Specific Transgene RNA Degradation in Plants is Initiated by Localized Introduction of Ectopic Promoterless DNA," *Cell*, 95:177-187 (1998).
Wakelin et al., "A target-site mutation is present in a glyphosate-resistant *Lolium rigidum* population," *Weed Res.* (Oxford), 46(5):432-440 (2006).
Walton et al., "Prediction of antisense oligonucleotide binding affinity to a structured RNA target," *Biotechnol Bioeng* 65(1):1-9 (1999).
Wan et al., "Generation of Large Numbers of Independently Transformed Fertile Barley Plants," *Plant Physiol.*, 104:37-48 (1994).
Wardell, "Floral Induction of Vegetative Plants Supplied a Purified Fraction of Deoxyribonucleic Acid from Stems of Flowering Plants," *Plant Physiol*, 60:885-891 (1977).
Wardell,"Floral Activity in Solutions of Deoxyribonucleic Acid Extracted from Tobacco Stems," *Plant Physiol*, 57:855-861 (1976).
Waterhouse et al., "Virus resistance and gene silencing in plants can be induced by simultaneous expression of sense and antisense RNA," *Proc Natl Acad Sci USA*, 95 13959-13964 (1998).
Welch et al., "Expression of ribozymes in gene transfer systems to modulate target RNA levels," *Curr Opin Biotechnol.* 9(5):486-496 (1998).
Wilson, et al., "Transcription termination at intrinsic terminators: The role of the RNA hairpin," *Proc. Natl. Acad. Sci. USA*, 92:8793-8797 (1995).
Winkler et al., "Thiamine derivatives bind messenger RNAs directly to regulate bacterial gene expression," *Nature*, 419:952-956 (2002).
Written Opinion dated May 8, 2014, in International Application No. PCT/IL2013/050447.
Written Opinion dated Sep. 1, 2014, in Singapore Patent Application No. 201206152-9.
Xu et al., Characterization and Functional Analysis of the Calmodulin-Binding Domain of Rac1 GTPase, *Plos One*, 7(8)1-12:e42975 (2012).
Yin et al., "Production of double-stranded RNA for interference with TMV infection utilizing a bacterial prokaryotic expression system," *Appl. Microbiol. Biotechnol.*, 84(2):323-333 (2009).
YouTube video by General Electric Company "Silwet Surfactants," screen shot taken on Jan. 11, 2012 of video of www.youtube.com/watch?v=WBw7nXMqHk8 (uploaded Jul. 13, 2009).
Zagnitko, "Lolium regidum clone LS1 acetyl-CoA carboxylase mRNA, partial cds; nuclear gene for plastid product," GenBank: AF359516.1, 2 pages (2001).
Zagnitko, et al., "An isoleucine/leucine residue in the carboxyltransferase domain of acetyl-CoA carboxylase is critical for interaction with aryloxyphenoxypropionate and cyclohexanedione inhibitors," *PNAS*, 98(12):6617-6622 (2001).
Zhang et al., "A novel rice gene, NRR responds to macronutrient deficiency and regulates root growth," *Mol Plant*, 5(1):63-72 (2012).
Zhang et al., "*Agrobacterium*-mediated transformation of *Arabidopsis thaliana* using the floral dip method," *Nature Protocols*, 1(2):1-6 (2006).
Zhang et al., "Cationic lipids and polymers mediated vectors for delivery of siRNA," *Journal of Controlled Release*, 123:1-10 (2007).
Zhang et al., "DEG: a database of essential genes," *Nucleic Acids Res.*, 32:D271-D272 (2004).
Zhang et al., "Transgenic rice plants produced by electroporation-mediated plasmid uptake into protoplasts," *The Plant Cell Rep.*, 7:379-384 (1988).

Zhao et al., "*Phyllotreta striolata* (Coleoptera: Chrysomelidae):Arginine kinase cloning and RNAi-based pest control," *European Journal of Entomology*, 105(5):815-822 (2008).
Zhu et al., "Ingested RNA interference for managing the populations of the Colorado potato beetle, *Leptinotarsa decemlineata*," *Pest Manag Sci*, 67:175-182 (2010).
Communication pursuant to Article 94(3) EPC dated Oct. 23, 2015, as received in European Patent Application No. 12 831 945.6.
Final Office Action dated Nov. 10, 2015, in U.S. Appl. No. 13/612,985.
Final Office Action dated Nov. 30, 2015, in U.S. Appl. No. 13/612,948.
First Office Action dated Mar. 12, 2015, in Chinese Patent Application No. 201280053984.9.
First Office Action dated Mar. 2, 2015, in Chinese Patent Application No. 201280054819.5.
First Office Action dated Jul. 7, 2015, in Chinese Patent Application No. 201280054820.8.
Invitation to Pay Additional Fees dated Sep. 8, 2015, in International Application No. PCT/US2015/037015.
Invitation to Pay Additional Fees dated Sep. 9, 2015, in International Application No. PCT/US2015/037522.
Lein et al., "Target-based discovery of novel herbicides," Current Opinion in Plant Biology, 7:219-225 (2004).
Nord-Larsen et al., "Cloning, characterization and expression analysis of tonoplast intrinsic proteins and glutamine synthetase in ryegrass (*Lolium perenne* L.)," *Plant Cell Reports*, 28(10):1549-1562 (2009).
Notice of Allowance dated Oct. 5, 2015, in U.S. Appl. No. 13/583,302.
Office Action dated Oct. 5, 2015, in Eurasian Patent Application No. 201201264/28.
Office Action dated Sep. 9, 2015, in Chinese Patent Application No. 201280055409.2.
Wang et al., "Foliar uptake of pesticides—Present status and future challenge," ScienceDirect, 87:1-8 (2007).
Agrios, *Plant Pathology* (Second Edition), 2:466-470 (1978).
Bai et al., "Naturally Occurring Broad-Spectrum Powdery Mildew Resistance in a Central American Tomato Accession is Caused by Loss of Mlo Function," *MPMI*, 21(1):30-39 (2008).
Bourgeois et al., "Field and producer survey of ACCase resistant wild oat in Manitoba," *Canadian Journal of Plant Science*, 709-715 (1997).
Brugière et al., "Glutamine Synthetase in the Phloem Plays a Major Role in Controlling Proline Production," *The Plant Cell*, 11:1995-2011 (1999).
Campbell et al., "Gene-knockdown in the honey bee mite *Varroa destructor* by a non-invasive approach: studies on a glutathione S-transferase," *Parasites & Vectors*, 3(1):73, pp. 1-10 (2010).
Chang et al., "Cellular Internalization of Fluorescent Proteins via Arginine-rich Intracellular Delivery Peptide in Plant Cells," *Plant Cell Physiol.*, 46(3):482-488 (2005).
Chupp et al., "Chapter 8: White Rust," *Vegetable Diseases and Their Control*, The Ronald Press Company, New York, pp. 267-269 (1960).
Communication pursuant to Article 94(3) EPC dated Jun. 26, 2015, as received in European Patent Application No. 11 753 916.3.
Desai et al., "Reduction in deformed wing virus infection in larval and adult honey bees (*Apis mellifera* L.) by double-stranded RNA ingestion," *Insect Molecular Biology*, 21(4):446-455 (2012).
Emery et al., "Radial Patterning of *Arabidopsis* Shoots by Class III HD-ZIP and KANADI Genes," *Current Biology*, 13:1768-1774 (2003).
Extended European Search Report dated Jun. 29, 2015, in European Patent Application No. 12 831 494.5.
Final Office Action dated Nov. 7, 2013, in U.S. Appl. No. 13/042,856.
First Office Action dated May 27, 2015, in Chinese Patent Application No. 201280054179.8.
International Preliminary Report on Patentability (Chapter II) dated Jul. 24, 2015, in International Application No. PCT/US2014/047204.
International Search Report and Written Opinion dated Jul. 8, 2015, in International Application No. PCT/US2015/011408.
International Search Report and Written Opinion dated Mar. 26, 2015, in International Application No. PCT/US2014/069353.

(56) References Cited

OTHER PUBLICATIONS

Jofre-Garfias et al., "*Agrobacterium*-mediated transformation of Amaranthus *hypochondriacus*: light- and tissue-specific expression of a pea chlorophyll a/b-binding protein promoter," *Plant Cell Reports*, 16:847-852 (1997).
Khan et al., "Matriconditioning of Vegetable Seeds to Improve Stand Establishment in Early Field Plantings," *J. Amer. Soc. Hort. Sci.*, 117(1):41-47 (1992).
Kim et al., "Synthetic dsRNA Dicer substrates enhance RNAi potency and efficacy," *Nature Biotechnology*, 23(2):222-226 (2005).
Leopold et al., "Chapter 4: Moisture as a Regulator of Physiological Reaction in Seeds," *Seed Moisture, CSSA Special Publication No. 14*, pp. 51-69 (1989).
MacKenzie et al., "Transgenic *Nicotiana debneyii* expressing viral coat protein are resistant to potato virus S infection," *Journal of General Virology*, 71:2167-2170 (1990).
Maori et al., "IAPV, a bee-affecting virus associated with Colony Collapse Disorder can be silenced by dsRNA ingestion," *Insect Molecular Biology*, 18(1):55-60 (2009).
Molina et al., "Inhibition of protoporphyrinogen oxidase expression in *Arabidopsis* causes a lesion-mimic phenotype that induces systemic acquired resistance," *The Plant Journal*, 17(6):667-678 (1999).
Non-Final Office Action dated Apr. 11, 2013, in U.S. Appl. No. 13/042,856.
Non-Final Office Action dated Aug. 12, 2015, in U.S. Appl. No. 13/612,936.
Non-Final Office Action dated Aug. 13, 2015, in U.S. Appl. No. 13/612,929.
Non-Final Office Action dated Jul. 23, 2015, in U.S. Appl. No. 14/335,135.
Non-Final Office Action dated Jul. 30, 2014, in U.S. Appl. No. 13/042,856.
Non-Final Office Action dated Jun. 5, 2015, in U.S. Appl. No. 13/612,948.
Non-Final Office Action dated Jun. 8, 2015, in U.S. Appl. No. 13/612,941.
Non-Final Office Action dated Mar. 30, 2015, in U.S. Appl. No. 13/583,302.
Non-Final Office Action dated May 15, 2015, in U.S. Appl. No. 14/608,951.
Non-Final Office Action dated May 22, 2015, in U.S. Appl. No. 13/612,985.
Orbović et al., "Foliar-Applied Surfactants and Urea Temporarily Reduce Carbon Assimilation of Grapefruit Leaves," *J. Amer. Soc. Hort. Sci.*, 126(4):486-490 (2001).
Pratt et al., "Amaranthus rudis and A. tuberculatus, One Species or Two?," *Journal of the Torrey Botanical Society*, 128(3):282-296 (2001).
Restriction Requirement dated Feb. 12, 2015, in U.S. Appl. No. 13/612,985.
Restriction Requirement dated Mar. 12, 2015, in U.S. Appl. No. 13/612,948.
Restriction Requirement dated Mar. 4, 2015, in U.S. Appl. No. 13/612,941.
Restriction Requirement dated May 4, 2015, in U.S. Appl. No. 13/612,929.
Restriction Requirement dated May 5, 2015, in U.S. Appl. No. 13/612,936.
Restriction Requirement dated May 7, 2015, in U.S. Appl. No. 13/612,925.
Restriction Requirement dated May 7, 2015, in U.S. Appl. No. 13/612,995.
Restriction Requirement dated Oct. 2, 2012, in U.S. Appl. No. 13/042,856.
Restriction Requirement dated Oct. 21, 2014, in U.S. Appl. No. 13/583,302.
Riggins et al., "Characterization of de novo transcriptome for waterhemp (*Amaranthus tuberculatus*) using GS-FLX 454 pyrosequencing and its application for studies of herbicide target-site genes," *Pest Manag. Sci.*, 66:1042-1052 (2010).

Rose et al., "Functional polarity is introduced by Dicer processing of short substrate RNAs," *Nucleic Acids Research*, 33(13):4140-4156 (2005).
Rothnie et al., Pararetroviruses and Retroviruses: A Comparative Review of Viral Structure and Gene Expression Strategies, *Advances in Virus Research*, 44:1-67 (1994).
Schweizer et al., "Double-stranded RNA interferes with gene function at the single-cell level in cereals," *The Plant Journal*, 24(6):895-903 (2000).
Senthil-Kumar et al., "A systematic study to determine the extent of gene silencing in Nicotiana benthamiana and other Solanaceae species when heterologous gene sequences are used for virus-induced gene silencing," *New Phytologist*, 176:782-791 (2007).
Snead et al., "Molecular basis for improved gene silencing by Dicer substrate interfering RNA compared with other siRNA variants," *Nucleic Acids Research*, 41(12):6209-6221 (2013).
Stevens et al., "New Formulation Technology—SILWET® Organosilicone Surfactants Have Physical and Physiological Properties Which Enhance the Performance of Sprays," *Proceedings of the 9th Australian Weeds Conference*, pp. 327-331 (1990).
Street, "Why is DNA (and not RNA) a stable storage form for genetic information?," *Biochemistry Revisited*, pp. 1-4 (2008).
Sutton et al., "Activity of mesotrione on resistant weeds in maize," *Pest Manag. Sci.*, 58:981-984 (2002).
Tank Mixing Chemicals Applied to Peanut Crops: Are the Chemicals Compatible?, College of Agriculture & Life Sciences, NC State University, AGW-653, pp. 1-11 (2004).
Taylor, "Seed Storage, Germination and Quality," *The Physiology of Vegetable Crops*, pp. 1-36 (1997).
Tranel et al., "Resistance of weeds to ALS-inhibiting herbicides: what have we learned?," *Weed Science*, 50:700-712 (2002).
Vermeulen et al., "The contributions of dsRNA structure to Dicer specificity and efficiency," *RNA*, 11(5):674-682 (2005).
Communication pursuant to Article 94(3) EPC dated Mar. 24, 2016, in European Patent Application No. 12 831 684.1.
Communication pursuant to Article 94(3) EPC dated Mar. 4, 2016, in European Patent Application No. 12 830 932.5.
Communication pursuant to Article 94(3) EPC dated Mar. 9, 2016, in European Patent Application No. 12 831 166.9.
Communication pursuant to Article 94(3) EPC dated Mar. 18, 2016, in European Patent Application No. 12 832 160.1.
Communication pursuant to Article 94(3) EPC dated Jan. 14, 2016, in European Patent Application No. 12 832 415.9.
Extended European Search Report dated Jan. 20, 2016, in European Patent Application No. 13 794 339.5.
First Office Action dated Feb. 2, 2016, in Chinese Patent Application No. 201380039346.6.
GenBank Accession No. GU120406, "Chrysomela tremulae ribosomal protein L7 (RpL7) mRNA, complete cds," (2009).
GenBank Accession No. Q4GXM3_BIPLU, "Ribosomal protein L7e" (2006).
GenBank Accession No. Y08611.1, "P.sativum mRNA for dihydropterin pyrophosphokinase/dihydropteroate synthase." (2006).
Gudkov, "Minireview: The L7/L12 ribosomal domain of the ribosome: structural and functional studies," *FEBS Letters*, 407:253-256 (1997).
Heffer et al., "Rapid isolation of gene homologs across taxa: Efficient identification and isolation of gene orthologs from non-model organism genomes, a technical report," *EvoDevo Journal*, 2(7):1-5 (2011).
Knudsen, "Promoter2.0: for the recognition of PolI promoter sequences," *Bioniformatics*, 15(5):356-361 (1999).
Migge et al., "Greenhouse-grown conditionally lethal tobacco plants obtained by expression of plastidic glutamine synthetase antisense RNA may contribute to biological safety," *Plant Science* 153:107-112 (2000).
Office Action dated Apr. 13, 2016, in Chinese Patent Application No. 201280053985.3.
Patent Examination Report No. 1 dated Feb. 8, 2016, in Australian Patent Application No. 2014262189.
Promoter Prediction for SEQ ID No. 1702 from 13/612929/MK/, Promoter 2.0 Prediction Results, pp. 1-4 (2016).

(56) References Cited

OTHER PUBLICATIONS

Salanenka et al., "Seedcoat Permeability: Uptake and Post-germination Transport of Applied Model Tracer Compounds," *HortScience*, 46(4):622-626 (2011).
Scott et al., Botanical Insecticides for Controlling Agricultural Pests: Piperamides and the Colorado Potato Beetle *Leptinotarsa decemlineata* Say (Coleoptera: Chrysomelidae), *Archives of Insect Biochemistry and Physiology*, 54:212-225 (2003).
Second Office Action dated Mar. 4, 2016, in Chinese Patent Application No. 201280054820.8.
Second Office Action dated Feb. 25, 2016, in Chinese Patent Application No. 201280054179.8.
Shintani et al., "Antisense Expression and Overexpression of Biotin Carboxylase in Tobacco Leaves," *Plant Physiol.*, 114:881-886 (1997).
Written Opinion dated Apr. 7, 2016, in Singapore Patent Application No. 201206152-9.
Chen et al., "Transfection and Expression of Plasmid DNA in Plant Cells by an Arginine-Rich Intracellular Delivery Peptide without Protoplast Preparation," *FEBS Letters 581*, pp. 1891-1897 (2007).
Coticchia et al., "Calmodulin modulates Akt activity in human breast cancer cell lines," *Breast Cancer Res. Treat*, 115:545-560 (2009).
Farooq et al., "Rice seed priming," *IPRN*, 30(2):45-48 (2005).
Fukunaga et al., "dsRNA with 5' overhangs v contributes to endogenous and antiviral RNA silencing pathways in plants," *The EMBO Journal*, 28(5):545-555 (2009).
GenBank Accession No. CB377464, "CmaEl_37_J02_T3 Cowpea weevil larvae Lambda Zap Express Library Callosobruchus maculatus cDNA, mRNA sequence," (2007).
Mora et al., "How Many Species are There on Earth and in the Ocean?," *PLOS Biol.*, 9(8):e100127, p. 1-8 (2011).
Zhang et al., "Chapter 10: New Characteristics of Pesticide Research & Development," *New Progress of the world agriculture chemicals*, p. 209 (2010).
GenBank Accession No. FE348695, "CBIB7954.fwd CBIB_Daphnia_pulex_Chosen_One_Library_2 Daphnia pulex cDNA clone CBIB7954 5', mRNA sequence" (2011).
Regalado, "The Next Great GMO Debate," (2015) <www.technologyreview.com/s/540136/the-next-great-gmo-debate>.
Agricultural Chemical Usage 2006 Vegetables Summary, Agricultural Statistics Board, NASS, USDA, pp. 1-372 (2007.
Al-Kaff et al., Plants Rendered Herbicide-susceptible by Cauliflower Mosaic Virus-elicited Suppression of a 35S Promoter-regulated Transgene, *Nature Biotechnology*, 18:995-999 (2000).
Anonymous, Resistant Weeds Spur Research Into New Technologies, Grains Research & Development Corporation, 2013.
Artymovich, "Using RNA interference to Increase Crop Yield and Decrease Pest Damage," *MMG 445 Basic Biotech.*, 5(1):7-12 (2009).
Ascencio-Ibanez et al., DNA abrasion onto plants is an Effective Method for Geminivirus infection and Virus-induced Gene Silencing, *Journal of Virological Methods*, 142:198-203 (2007).
Bachman et al., "Characterization of the spectrum of insecticidal activity of a double-stranded RNA with targeted activity against Western Corn Rootworm (*Diabrotica virgifera virgifera* LeConte)," *Transgenic Res.*, pp. 1-16 (2013).
Baker, "Chlorophyll Fluorescence: A Probe of Photosynthesis In Vivo," *Annu. Rev. Plant Biol.*, 59: 89-113 (2018).
Balibrea et al., "Extracellular Invertase is an Essential Component of Cytokinin-Mediated Delay of Senescence," *The Plant Cell*, 16(5):1276-1287 (2004).
Bart et al., A Novel System for Gene Silencing using siRNAs in Rice Leaf and stem-Derived Protoplasts, *Plant Methods*, 2(13):1-9 (2006).
Basu et al., Weed Genomics: New Tools to Understand Weed biology, *TRENDS in Plant Science*, 9(8):391-398 (2004).
Bauer et al., The Major Protein import Receptor of Plastids is Essential for Chloroplast Biogenesis, *Nature*, 403:203-207 (2000).
Bedell et al., Sorghum Genome Sequencing by Methylation Filtration, *PLOS Biology*, 3(1):E13/104-115 (2005).
Chabannes et al., In situ Analysis of Lignins in Transgenic Tobacco Reveals a Differential Impact of individual Transformations on the Spatial Patterns of Lignin Deposition at the Cellular and Subcellular Levels, *The Plant Journal*, 28(3):271-282 (2001).
Chen et al., Transfection and Expression of Plasmid DNA in Plant Cells by an Arginine-Rich Intracellular Delivery Peptide without Protoplast Preparation, *FEBS Letters*, 581:1891-1897 (2007).
Chen et al., Exploring MicroRNA-Like Small RNAs in the Filamentous Fungus *Fusarium oxysporum*, *PLOS One*, 9(8):e104956:1-10 (2014).
Cheng et al., Transient Expression of Minimum Linear Gene Cassettes in Onion Epidermal Cells Via Direct Transformation, *Appl Biochem Biotechnol*, 159:739-749 (2009).
Christiaens et al., The Challenge of RNAi-mediated Control of Hemipterans, *Current Opinion in Insect Science*, 6:15-21 (2014).
Colliver et al., "Differential Modification of Flavonoid and Isoflavonoid Biosynthesis with an Antisense Chalcone Synthase Construct in Transgenic Lotus Corniculatus," *Plant Molecular Biology*, 35:509-522 (1997).
Communication pursuant to Article 94(3) EPC dated Jun. 26, 2015, in European Patent Application No. 11 753 916.3.
Communication pursuant to Article 94(3) EPC dated Oct. 23, 2015, in European Patent Application No. 12 831 945.6.
Concise Descriptions of Relevance filed by a third party on Nov. 29, 2012, in U.S. Appl. No. 13/042,856.
Constan et al., An Outer Envelope Membrane Component of the Plastid Protein Import Apparatus Plays an Essential Role in *Arabidopsis*, *The Plant Journal*, 38:93-106 (2004).
Dalakouras et al., Induction of Silencing in Plants by High-Pressure Spraying of In vitro-Synthesized Small RNAs, *Frontiers in Plant Science*, 7(1327):1-5 (2016).
Dawson et al., cDNA Cloning of the Complete Genome of Tobacco Mosaic Virus and Production of Infectious Transcripts, *Proc. Natl. Acad. Sci. USA*, 83:1832-1836 (1986).
Di Stilio et al., Virus-Induced Gene Silencing as a Tool for Comparative Functional Studies in Thalictrum, *PLoS One*, 5(8):e12064 (2010).
Eamens et al., RNA Silencing in Plants: Yesterday, Today, and Tomorrow, *Plant Physiology*, 147(2):456-468 (2008).
Egli et al., A Maize Acetyl-Coenzyme A Carboxylase cDNA Sequence, *Plant Physiol.*, 108:1299-1300 (1995).
Eudes et al., Cell-penetrating peptides, *Plant Signaling & Behavior*, 3(8):549-5550 (2008).
Examination Report dated Mar. 1, 2018, in Australian Patent Application No. 2013264742.
Extended European Search Report dated Sep. 7, 2017, in European Patent Application No. 17152830.0.
Extended European Search Report dated Nov. 7, 2017, in European Patent Application No. 15811092.4.
Extended European Search Report dated Nov. 8, 2017, in European Patent Application No. 15737282.2.
Extended European Search Report dated Oct. 8, 2013, in European Patent Application No. 11753916.3.
Extended European Search Report dated Sep. 29, 2016, in European Patent Application No. 14778840.0.
Extended European Search Report dated Mar. 15, 2018, in European Patent Application No. 17181861.0.
Fassler, BLAST Glossary, National Center for Biotechnology Information (2011).
Fernandez et al., Uptake of Hydrophilic Solutes Through Plant Leaves: Current State of Knowledge and Perspectives of Foliar Fertilization, *Critical Reviews in Plant Sciences*, 28:36-38 (2009).
Feuillet et al., "Crop Genome Sequencing: Lessons and Rationales," *Trends Plant Sci.*, 16:77-88 (2011).
Final Office Action dated Apr. 7, 2016, in U.S. Appl. No. 13/619,980.
Final Office Action dated Dec. 17, 2015, in U.S. Appl. No. 14/335,135.
Final Office Action dated Feb. 4, 2016, in U.S. Appl. No. 13/612,936.
Final Office Action dated Feb. 17, 2016, in U.S. Appl. No. 13/612,929.
Final Office Action dated Jun. 30, 2016, in U.S. Appl. No. 13/901,326.
Final Office Action dated Mar. 2, 2016, in U.S. Appl. No. 13/612,995.
Final Office Action dated Mar. 21, 2016, in U.S. Appl. No. 13/612,925.
Final Office Action dated May 26, 2016, in U.S. Appl. No. 14/532,596.
Final Office Action dated Nov. 10, 2016, in U.S. Appl. No. 13/583,302.

(56) References Cited

OTHER PUBLICATIONS

Final Office Action dated Nov. 19, 2015, in U.S. Appl. No. 13/612,941.
Final Office Action dated Oct. 20, 2016, in U.S. Appl. No. 14/480,199.
Final Office Action dated Oct. 22, 2015, in U.S. Appl. No. 14/608,951.
Final Office Action dated Sep. 9, 2016, in U.S. Appl. No. 13/612,954.
Final Office Action dated Sep. 9, 2016, in U.S. Appl. No. 14/608,951.
Final Office Action dated Sep. 9, 2016, in U.S. Appl. No. 14/603,347.
First Office Action dated Aug. 31, 2015, in Chinese Patent Application No. 201280053985.3.
First Office Action dated Sep. 9, 2015, in Chinese Patent Application No. 201280055409.2.
Fraley et al., "Liposome-mediated Delivery of Tobacco Mosaic Virus RNA into Tobacco Protoplasts: A Sensitive Assay for Monitoring Liposome-protoplast Interactions," *Proc Natl Acad Sci USA*, 79(6):1859-1863 (1982).
Friedberg, Automated Protein Function Prediction—the Genomic Challenge, *Briefings in Bioinformatics*, 7(3):225-242 (2006).
Fridlund, "Distribution of Chlorotic Leaf Spot Virus in Apple Budsticks," *Plant Dis. Reptr.*, 57: 865-869 (1973).
Fukunaga et al., dsRNA with 5' Overhangs Contributes to Endogenous and Antiviral RNA Silencing Pathways in Plants, *The EMBO Journal*, 28(5):545-555 (2009).
Funke et al., Molecular Basis for Herbicide Resistance in Roundup Ready crops, *PNAS*, 103:13010-13015 (2006).
Gan et al., Inhibition of Leaf Senescence by Autoregulated Production of Cytokinin, *Science*, 270:1986-1988 (1995).
Gan et al., Bacterially Expressed dsRNA Protects Maize Against SCMV Infection, *Plant Cell Rep*, 29(11):1261-1268 (2010).
Gao et al., Nonviral Methods for siRNA Delivery, *Molecular Pharmaceutics*, 6(3):651-658 (2008).
Gaskin et al., Novel Organosillicone Adjuvants to Reduce Agrochemical Spray Volumes on Row Crops, *New Zealand Plant Protection*, 53:350-354 (2000).
Gasser et al., Structure, Expression, and Evolution of the 5-Enolpyruvylshikimate-3-phosphate Synthase Genes of Petunia and Tomato, *J. Biol. Chem.*, 263: 4280-4287 (1988).
GenBank Accession No. CB377464, CmaE1_37_J02_T3 Cowpea Weevil Larvae Lambda Zap Express Library *Callosobruchus maculatus* cDNA, mRNA sequence, (2007).
GenBank Accession No. EF143582 (2007).
GenBank Accession No. EW765249, ST020010B10C12 Normalized and Subtracted Western Corn Rootworm Female Head cDNA Library *Diabrotica virgifera virgifera* cDNA Clone STO20010B10C12 5-, mRNA Sequence, (2007).
GenBank Accession No. EW771198, "ST020010B10C12 Normalized and Subtracted Western Corn Rootworm Female Head cDNA Library *Diabrotica virgifera virgifera* cDNA Clone STO20010B10C12 5-, mRNA Sequence," (2007).
Gilmer et al., "Latent Viruses of Apple: I. Detection with Woody indicators," *NY St. Agr. Exp. Sta.* (Geneva), 1(10): 1-9 (1971).
Gomez-Zurita et al., Recalibrated Tree of Leaf Beetles (*Chrysomelidae*) Indicates Independent Diversification of Angiosperms and Their Insect Herbivores, *PLoS One*, 4(e360):1-8 (2007).
Gossamer Threads, Compendium of Herbicide Adjuvants: Organo-Silicone Surfactant, p. 1-4 (1998).
Hagio, Chapter 25: Direct Gene Transfer into Plant Mature Seeds via Electroporation After Vacuum Treatment, Electroporation and Sonoporation in Developmental Biology, p. 285-293 (2009).
Hajirezaei et al., Impact of Elevated Cytosolic and Apoplastic Invertase Activity on Carbon Metabolism During Potato Tuber Development, *Journal of Experimental Botany*, 51:439-445 (2000).
Hess, Surfactants and Additives, *1999 Proceedings of the California Weed Science Society*, 51:156-172 (1999).
Hoermann et al., Tic32, as Essential Component in Chloroplast Biogenesis, *The Journal of Biological Chemistry*, 279(33):34756-34762 (2004).
Huang et al., In Vivo Analyses of the Roles of Essential Omp85-Related Proteins in the Chloroplast Outer Envelope Membrane, *Plant Physiol.*, 157:147-159 (2011).

Huggett et al., "Real-time RT-PCR Normalization; Strategies and Considerations," *Genes and Immunity*, 6: 279-284 (2005).
Inaba et al., *Arabidopsis* Tic110 Is Essential for the Assembly and Function of the Protein Import Machinery of Plastids, *The Plant Cell*, 17:1482-1496 (2005).
International Preliminary Report on Patentability dated Sep. 11, 2012, in International Application No. PCT/US2011/027528.
International Rice Genome Sequencing Project, The map-based Sequence of the Rice Genome, Nature, 436(11):793-800 (2005).
International Search Report and Written Opinion dated May 26, 2016, in International Application No. PCT/US2016/014344.
International Search Report and Written Opinion dated Nov. 24, 2015, in International Application No. PCT/US2015/037522.
International Search Report and Written Opinion dated Nov. 27, 2015, in International Application No. PCT/US2015/037015.
Ivanova et al., Members of the Toc159 Import Receptor Family Represent Distinct Pathways for Protein Targeting to Plastids, *Molecular Biology of the Cell*, 15:3379-3392 (2004).
Jacque et al., Modulation of HIV-1 replication by RNA interference, *Nature*, 418, 435-438 (2002).
Jang et al., Resistance to Herbicides Caused by Single Amino Acid Mutations in acetyl-CoA Carboxylase in Resistant Populations of Grassy Weeds, *New Phytologist*, 197(4):1110-1116 (2013).
Jarvis et al., An *Arabidopsis* Mutant Defective in the Plastid General Protein import Apparatus, *Science*, 282:100-103 (1998).
Jin et al., "Posttranslational Elevation of Cell Wall Invertase Activity by Silencing its Inhibitor in Tomato Delays Leaf Senescence and Increases Seed Weight and Fruit Hexose Level," *The Plant Cell*, 21:2072-2089 (2009).
Kaloumenos et al., "Identification of a Johnsongrass (*Sorghum halepense*) Biotype Resistant to ACCase-Inhibiting Herbicides in Northern Greece," *Weed Technol*, 23:470-476 (2009).
Kambiranda et al., "Relationship Between Acid Invertase Activity and Sugar Content in Grape Species," *Journal of Food Biochemistry*, 35:1646-1652 (2011).
Kikkert et al., Stable Transformation of Plant Cells by Particle Bombardment/Biolistics, *Methods in Molecular Biology*, 286:61-78 (2005).
Kim et al., "Optimization of Conditions for Transient Agrobacterium-Mediated Gene Expression Assays in *Arabidopsis*," *Plant Cell Reports*, 28:1159-1167 (2009).
Kirkwood, "Herbicides and Plants," *Botanical Journal of Scotland*, 46(3):447-462 (1993).
Kovacheva et al., In vivo studies on the roles of Tic100, Tic40 and Hsp93 during chloroplast protein import, *The Plant Journal*, 41:412-428 (2005).
Kovacheva et al., Further in vivo studies on the role of the molecular chaperone, Hsp93, in plastid protein import, *The Plant Journal*, 50:364-379 (2007).
Li et al., Long dsRNA but not siRNA initiates RNAi in western corn rootworm larvae and adults, *Journal of Applied Entomology*, 139(6):432-445 (2015).
Liu et al., "Identification and Application of a Rice Senescence-Associated Promoter," *Plant Physiology*, 153:1239-1249 (2010).
Liu, "The Transformation of Nucleic Acid Degradants in Plants," China Organic Fertilizers, Agriculture Press, ISBN: 7-1091634 (with English translation) (1991).
Liu, "Influence of Sugars on the Foliar Uptake of Bentazone and Glyphosate," *New Zealand Plant Protection*, 55:159-162 (2002).
Luque et al., "Water Permeability of Isolated Cuticular Membranes: A Structural Analysis," *Archives of Biochemistry and Biophysics*, 317(2):417-422 (1995).
McGinnis, RNAi for functional genomics in plants, *Brief Funct Genomics*, 9(2):111-7 (2010).
Mora et al., "How Many Species Are There on Earth and in the Ocean?," *PLOS Biol.*, 9(8):e100127, pp. 1-8 (2011).
Mount et al., "Gene and Metabolite Regulatory Network Analysis of Early Developing Fruit Tissues Highlights New Candidate Genes for the Control of Tomato Fruit Composition and Development," *Plant Physiology*, 149:1505-1528 (2009).
Németh, "The Virus, Mycoplasma and Rickettsia Diseases of Fruit Trees," Martinus Nijhoff Publishers, The Netherlands and Akadémiai Kiadó, Hungary, 1986, ISBN 90-247-2868-1, pp. 197-204 (1986).

(56) References Cited

OTHER PUBLICATIONS

Non-Final Office Action dated Apr. 29, 2016, in U.S. Appl. No. 13/583,302.
Non-Final Office Action dated Aug. 3, 2016, in U.S. Appl. No. 14/015,715.
Non-Final Office Action dated Aug. 5, 2016, in U.S. Appl. No. 14/015,785.
Non-Final Office Action dated Aug. 8, 2016, in U.S. Appl. No. 13/612,936.
Non-Final Office Action dated Aug. 10, 2016, in U.S. Appl. No. 13/612,995.
Non-Final Office Action dated Aug. 19, 2016, in U.S. Appl. No. 13/612,925.
Non-Final Office Action dated Aug. 19, 2016, in U.S. Appl. No. 13/612,929.
Non-Final Office Action dated Dec. 17, 2015, in U.S. Appl. No. 14/532,596.
Non-Final Office Action dated Feb. 10, 2016, in U.S. Appl. No. 13/901,326.
Non-Final Office Action dated Feb. 23, 2016, in U.S. Appl. No. 14/603,347.
Non-Final Office Action dated Feb. 23, 2016, in U.S. Appl. No. 14/608,951.
Non-Final Office Action dated Mar. 1, 2016, in U.S. Appl. No. 13/612,954.
Non-Final Office Action dated Mar. 21, 2018, in U.S. Appl. No. 13/619,980.
Non-Final Office Action dated Nov. 9, 2016, in U.S. Appl. No. 14/901,003.
Non-Final Office Action dated Oct. 3, 2016, in U.S. Appl. No. 14/403,491.
Non-Final Office Action dated Sep. 1, 2015, in U.S. Appl. No. 13/612,954.
Non-Final Office Action dated Sep. 11, 2015, in U.S. Appl. No. 13/612,925.
Non-Final Office Action dated Sep. 4, 2015, in U.S. Appl. No. 13/612,995.
Non-Final Office Action dated Sep. 6, 2016, in U.S. Appl. No. 14/335,135.
Nookaraju et al., "Molecular approaches for enhancing sweetness in fruits and vegetables," *Scientia Horticulture*, 127:1-15 (2010).
Notice of Allowance dated Apr. 11, 2016, in U.S. Appl. No. 13/612,985.
Notice of Allowance dated Apr. 19, 2016, in U.S. Appl. No. 13/612,941.
Notice of Allowance dated Apr. 20, 2016, in U.S. Appl. No. 13/612,948.
Notice of Allowance dated Feb. 23, 2015, in U.S. Appl. No. 13/042,856.
Notice of Allowance dated Jun. 2, 2015, in U.S. Appl. No. 13/042,856.
Office Action dated Aug. 1, 2017, in European Patent Application No. 12 830 932.5.
Office Action dated Aug. 3, 2017, in Chinese Patent Application No. 201480014392.5 (with English translation).
Office Action dated Aug. 3, 2017, in European Patent Application No. 12 831 684.1.
Office Action dated Aug. 8, 2017, in Chilean Patent Application No. 201501874.
Office Action dated Aug. 14, 2017, in Israeli Patent Application No. 235878.
Office Action dated Aug. 22, 2017, in Korean Patent Application No. 10-2012-7023415.
Office Action dated Aug. 25, 2016, in Eurasian Patent Application No. 201201264.
Office Action dated Aug. 28, 2013, in Chinese Patent Application No. 201180012795.2.
Office Action dated Dec. 13, 2016, in Ukrainian Patent Application No. a 2014 03843.
Office Action dated Dec. 14, 2016, in Ukrainian Patent Application No. a 2014 03850.
Office Action dated Dec. 15, 2016, in Ukrainian Patent Application No. a 2014 03845.
Office Action dated Dec. 15, 2016, in Ukrainian Patent Application No. a 2014 03852.
Office Action dated Dec. 15, 2016, in Ukrainian Patent Application No. a 2014 03849.
Office Action dated Dec. 27, 2016, in Ukrainian Patent Application No. a 2012 11548.
Office Action dated Dec. 5, 2017, in Japanese Patent Application No. 2016-502033.
Office Action dated Feb. 21, 2018, in Mexican Patent Application No. MX/a/2015/012632 (with English translation).
Office Action dated Feb. 24, 2014, in Eurasian Patent Application No. 201201264.
Office Action dated Jul. 11, 2017, in Mexican Patent Application No. MX/a/2015/013118 (with English translation).
Office Action dated Jul. 18, 2016, in Indonesian Patent Application No. W00201203610.
Office Action dated Jul. 23, 2015, in Ukrainian Patent Application No. 201211548.
Office Action dated Jul. 3, 2017, in Mexican Patent Application No. MX/a/2015/012632 (with English translation).
Office Action dated Jul. 6, 2017, in Mexican Patent Application No. MX/a/2015/013103 (with English translation).
Office Action dated Jun. 20, 2016, in Chinese Patent Application No. 201280054819.5.
Office Action dated Jun. 24, 2016, in Chinese Patent Application No. 201280053984.9.
Office Action dated Mar. 16, 2017, in Chinese Patent Application No. 201280054819.5.
Office Action dated Mar. 8, 2018 (with English translation), in Chilean Patent Application No. 201403192.
Office Action dated May 3, 2016, in Chilean Patent Application No. 201601057.
Office Action dated Nov. 15, 2016, in Mexican Patent Application No. MX/a/2014/003068 (with English translation).
Office Action dated Sep. 5, 2016, in Ukrainian Patent Application No. a 2014 03846.
Office Action dated Sep. 6, 2017, in Chinese Patent Application No. 2014800154012 (with English translation).
Office Action dated Nov. 3, 2014, in Chinese Patent Application No. 201180012795.2.
Partial European Search Report dated Dec. 6, 2017, in European Patent Application No. 17181861.0.
Partial Supplementary European Search Report dated Jan. 11, 2018, in European Patent Application No. 15812530.0.
Patent Examination Report No. 1 dated Jun. 17, 2016, in Australian Patent Application No. 2012308659.
Patent Examination Report No. 1 dated Jun. 17, 2016, in Australian Patent Application No. 2012308660.
Patent Examination Report No. 1 dated Jun. 8, 2017, in Australian Patent Application No. 2012308686.
Patent Examination Report No. 1 dated Nov. 11, 2013, in Australian Patent Application No. 2011224570.
Promoter Prediction for SEQ ID No. 4 from 13/612995/MK/, Promoter 2.0 Prediction Results, pp. 1-3 (2016).
Promoter Prediction for SEQ ID No. 7 from 13/612936/MK/, Promoter 2.0 Prediction Results, pp. 1-2 (2016).
Promoter Prediction for SEQ ID No. 8 from 13/612,925/MK/, Promoter 2.0 Prediction Results, pp. 1-6 (2016).
Qichuan et al., Seed Science, China Agriculture Press, pp. 101-103, Tables 2-37 (2001).
Rakoczy-Trojanowska, Alternative Methods of Plant Transformation—a Short Review, *Cellular & Molecular Biology Letters*, 7:849-858 (2002).
Restriction Requirement dated Apr. 21, 2015, in U.S. Appl. No. 13/612,954.
Restriction Requirement dated Jul. 15, 2016, in U.S. Appl. No. 14/143,748.
Restriction Requirement dated Jul. 18, 2016, in U.S. Appl. No. 14/143,836.
Restriction Requirement dated Oct. 13, 2016, in U.S. Appl. No. 14/206,707.

(56) References Cited

OTHER PUBLICATIONS

Restriction Requirement dated Oct. 28, 2015, in U.S. Appl. No. 14/603,347.
Restriction Requirement dated Sep. 2, 2015, in U.S. Appl. No. 14/532,596.
Reverdatto et al., A Multisubunit Acetyl Coenzyme a Carboxylase from Soybean, *Plant Physiol.*, 119:961-978 (1999).
Richardson et al., Targeting and Assembly of Components of the TOC Protein Import Complex at the Chloroplast outer Envelope Membrane, *Frontiers in Plant Science*, 5:1-14 (2014).
Roberts, Fast-track applications: the potential for Direct Delivery of Proteins and Nucleic Acids to Plant Cells for the Discovery of Gene Function, *Plant Methods*, 1(12):1-3 (2005).
Robson et al., "Leaf senescence is delayed in maize expressing the Agrobacterium IPT gene under the control of a novel maize senescence-enhanced promoter," *Plant Biotechnology Journal*, 2:101-112 (2004).
Roitsch et al., Extracellular Invertase: Key Metabolic Enzyme and PR Protein, *Journal of Experimental Botany*, 54(382):513-524 (2003).
Roitsch et al., Function and Regulation of Plant Invertases: Sweet Sensations, *Trades in Plant Science*, 9(12):606-613 (2004).
Ruan et al., Suppression of Sucrose Synthase Gene Expression Represses Cotton Fiber Cell Initiation, Elongation, and Seed Development, *The Plant Cell*, 15:952-964 (2003).
Schönherr, Water Permeability of Isolated Cuticular Membranes: The Effect of pH and Cations on Diffusion, Hydrodynamic Permeability and Size of Polar Pores in the Cutin Matrix, *Planta*, 128:113-126 (1976).
Schönherr et al., "Size Selectivity of Aqueous Pores in Astomatous Cuticular Membranes Isolated from *Populus canescens* (Aiton) Sm. leaves," *Planta*, 219: 405-411 (2004).
Search Report dated Jul. 24, 2017, in Chinese Patent Application No. 201480014392.5 (with English translation).
Search Report dated Oct. 20, 2017, in Chinese Patent Application No. 201380039346.6.
Showalter, Structure and Function of Plant Cell Wall Proteins, *The Plant Cell*, 5:9-23 (1993).
Song et al., Herbicide, New Heterocyclic Pesticide, *Chemical Industry Press*, 354-356 (2011).
Statement of Grounds and Particulars dated Sep. 1, 2017, in Australian Patent No. 2014262189.
Stevens, Organosilicone Surfactants as Adjuvants for Agrochemicals, *Journal of Pesticide Science*, 38:103-122 (1993).
Stevens, Formulation of Sprays to Improve the Efficacy of Foliar Fertilisers, *New Zealand Journal of Forestry Science*, 24(1):27-34 (1994).
Summons to Attend Oral Proceedings Pursuant to Rule 115(1) EPC, dated Aug. 7, 2017, in European Patent Application No. 12832160.1.
Sun et al., Antisense Oligodeoxynucleotide inhibition as a Potentstrategy in Plant biology: identification of SUSIBA2 as Atranscriptional Activator in Plant Sugar Signaling, *The Plant Journal*, 44:128-138 (2005).
Tang et al., Efficient Delivery of Small interfering RNA to Plant Cells by a Nanosecond Pulsed Laser-induced Stress Wave for Posttranscriptional Gene Silencing, *Plant Science*, 171:375-381 (2006).
Temple et al., Can glutamine Synthetase Activity Levels be Modulated in Transgenic Plants by the Use of Recombinant DNA Technology? *Transgenic Plants and Plant Biochemistry*, 22(4):915-920 (1994).
Teng et al., Tic21 is an Essential Translocon Component for Protein Translocation across the Chloroplast Inner Envelope Membrane, *The Plant Cell*, 18:2247-2257 (2006).
Tenllado et al., Double-Stranded RNA-Mediated Interference with Plant Virus Infection, *Journal of Virology*, 75(24):12288-12297 (2001).
Thomas et al., Size constraints for targeting post-transcriptional gene silencing and for RNA-directed methylation in *Nicotiana benthamiana* using a potato virus X vector, *The Plant Journal*, 25(4):417-425 (2001).
Tice, "Selecting the Right Compounds for Screening: does Lipinski's rule of 5 for Pharmaceuticals Apply to Agrochemicals?" *Pest Manag. Sci.*, 2001, 57: 3-16.
Tomlinson et al., Evidence that the hexose-to-sucrose Ratio does not Control the Switch to Storage Product Accumulation in Oilseeds: Analysis of Tobacco Seed Development and Effects of Overexpressing Apoplastic Invertase, *Journal of Experimental Botany*, 55(406):2291-2303 (2004).
Tsugawa et al., Efficient Transformation of Rice Protoplasts Mediated by a Synthetic Polycationic Amino Polymer, *Theor Appl Genet*, 97:1019-1026 (1998).
Ulrich et al., Large Scale RNAi Screen in Tribolium Reveals Novel Target Genes for Pest Control and the Proteasome as Prime Target, *BMC Genomics*, 16(1):671 (2015).
Unniraman et al., Conserved Economics of Transcription Termination in Eubacteria, *Nucleic Acids Research*, 30(3):675-684 (2002).
Voinnet et al., Systemic Spread of Sequence-Specific Transgene RNA Degradation in Plants is Initiated by Localized Introduction of Ectopic Promoterless DNA, *Cell*, 95:177-187 (1998).
Voinnet, Origin, Biogenesis, and Activity of Plant MicroRNAs, *Cell*, 136:669-687 (2009).
Watson et al., "RNA Silencing Platforms in plants," *FEBS Lett.*, 579: 5982-5987 (2005).
Widholm et al., Glyphosate Selection of Gene Amplification in Suspension Cultures of 3 Plant Species, *Phyisologia Plantarum*, 112:540-545 (2001).
Wool et al., Structure and Evolution of Mammalian Ribosomal Proteins, *Biochem. Cell Biol*, 73:933-947 (1995).
Written Opinion dated Mar. 6, 2017, in Singaporean Patent Application No. 2012061529.
Xu et al., Characterization and Functional Analysis of the Calmodulin-Binding Domain of Rac1 GTPase, *PLoS One*, 7(8):e42975 (2012).
Zaimin et al., Chapter III Seeds and Seedlings, Botany, Northwest A&F University Press, pp. 87-92 (2009).
Zhang, Chapter 10: New Characteristics of Pesticide Research & Development, p. 209 (2010).
Zhong et al., A forward Genetic Screen to Explore Chloroplast Protein Import in Vivo Identifies Moco Sulfurase, Pivotal for ABA and IAA Biosynthesis and Purine Turnover, *The Plant Journal*, 63:44-59 (2010).
Zhong et al., A Pea Antisense Gene for the Chloroplast Stromal Processing Peptidase Yields Seedling Lethals in *Arabidopsis*: Survivors Show Defective GFP Import In Vivo, *The Plant Journal*, 34:802-812 (2003).
Zotti et al., RNAi Technology for Insect Management and Protection of Beneficial Insects From Diseases: Lessons, Challenges and Risk Assessments, *Neotropical Entomology*, 44(3):197-213 (2015).
Anonymous, "A handbook for high-level expression and purification of 6xHis-tagged proteins," *The QiaExpressionist* (2003).
Asad et al., "Silicon Carbide Whisker-mediated Plant Transformation," *Properties and Applications of Silicon Carbide*, pp. 345-358 (2011).
Baulcombe, "RNA silencing in plants," *Nature*, 431:356-363 (2004).
Baum et al., "Progress Towards RNAi-Mediated Insect Pest Management," *Advances in Insect Physiology*, 47:249-295 (2014).
Belhadj et al., "Methyl Jasmonate Induces Defense Responses in Grapevine and Triggers Protection against Erysiphe necator," *J. Agric Food Chem.*, 54:9119-9125 (2006).
Burgos et al., "Review: Confirmation of Resistance to Herbicides and Evaluation of Resistance Levels," *Weed Science*, 61 (1):4-20 (2013).
Busch et al., "RNAi for discovery of novel crop protection products," *Pflanzenschutz-Nachrichten Bayer*, 58(1):34-50 (2005).
Communication Pursuant to Article 94(3) EPC dated Sep. 5, 2018, in European Patent Application No. 17152830.0.
Cong et al., "Multiplex Genome Engineering Using CRISPR/Cas Systems," *Science*, 339:819-823 (2013).
Database EMBL XP-002781749(BG442539) dated Mar. 20, 2001.

(56) References Cited

OTHER PUBLICATIONS

Declaration of Jerzy Zabkiewicz executed Nov. 28, 2017, as filed by Opponent in Australian Patent Application No. 2014262189, pp. 1-73.
Declaration of Jerzy Zabkiewicz executed Nov. 28, 2017, as filed by Opponent in Australian Patent Application No. 2014262189, pp. 1-4.
Declaration of Neena Mitter executed Nov. 30, 2017, as filed by Opponent in Australian Patent Application No. 2014262189, pp. 1-114.
Declaration of Neena Mitter executed Nov. 30, 2017, as filed by Opponent in Australian Patent Application No. 2014262189, pp. 1-25.
Delye et al., "PCR-based detection of resistance to acetyl-CoA carboxylase-inhibiting herbicides in black-grass (*Alopecurus myosuroides* Huds) and ryegrass (*Lolium rigidum* Gaud)," *Pest Management Science*, 58:474-478 (2002).
Delye et al., "Variation in the gene encoding acetolactate-synthase in *Lolium* species and proactive detection of mutant, herbicide-resistant alleles," *Weed Research*, 49:326-336 (2009).
Desveaux et al., "PBF-2 is a Novel Single-Stranded DNA Binding Factor Implicated in PR-10a Gene Activation in Potato," *The Plant Cell*, 12:1477-1489 (2000).
Dietzgen et al., "Transgenic gene silencing strategies for virus control," Australasian Plant Pathology, 35:605-618 (2006).
Dilpreet et al., "Glyphosate Resistance in a Johnsongrass (*Sorghum halepense*) Biotype from Arkansas," *Weed Science*, 59(3):299-304 (2011).
Drobyazko., "Reliable and environmentally friendly insecticide," Protection and quarantine of plants, 2012 (pp. 52, 53) (in Russian).
Duhoux et al., "Reference Genes to Study Herbicide Stress Response in *Lolium* sp.: Up-Regulation of P3450 Genes in Plants Resistant to Acetolactate-Synthase Inhibitors," *PLOS One*, 8(5):e63576 (2013).
European Search Report dated Sep. 7, 2017, in European Patent Application No. 17152830.0.
Extended European Search Report dated Dec. 19, 2018, in European Patent Application No. 16804395.8.
Extended European Search Report dated Nov. 16, 2018, in European Patent Application No. 18182238.8.
Extended European Search Report dated Nov. 21, 2018, in European Patent Application No. 18175809.5.
Extended European Search Report dated Sep. 28, 2018, in European Patent Application No. 16740770.9.
Extended European Search Report dated Apr. 13, 2018, in European Patent Application No. 15812530.0.
Gao et al., "DNA-guided genome editing using the Natronobacterium gregoryi Argonaute," Nature Biotechnology, 34(7):768-773 (2016).
GenBank Accession No. AY545657.1 (2004).
GenBank Accession No. GI:186478573 (2014).
GenBank Accession No. HD315444, "Sequence 192160 from Patent EP2213738" (2010).
GenBank Accession No. U87257.1, "Daucus carota 4-hydroxyphenylpyruvate dioxygenase mRNA, complete cds" (1997).
GenBank Accession No. XM_014456745.1, PREDICTED: Myotis lucifugus ribonucleoprotein, PTB-binding 2 (RAVER2), transcript variant X3, mRNA,: (2015).
GenEmbl Accession No. FJ861243 (2010).
Guttieri et al., "DNA Sequence Variation in Domain A of the Acetolactate Synthase Genes of Herbicide-Resistant and -Susceptible Weed Biotypes," *Weed Science*, 40:670-679 (1992).
Holtra et al., "Assessment of the Physiological Condition of *Salvinia natans* L. Exposed to Copper(II) Ions," *Environ. Protect. Eng.*, 41:147-158 (2015).
Hörmann et al., "Tic32, as Essential Component in Chloroplast Biogenesis," *The Journal of Biological Chemistry*, 279(33):34756-34762 (2004).
Horsch et al., "Inheritance of Functional Foreign Genes in Plants ," *Science*, 223:496-498 (1984).
Hsu et al., "DNA targeting specificity of RNA-guided Cas9 nucleases," *Nature Biotechnology*, 31:827-832 (2013).
Hu et al., "High efficiency transport of quantum dots into plant roots with the aid of silwet L-77," *Plant Physiology and Biochemistry*, 48:703-709 (2010).
International Search Report dated Oct. 13, 2016, in International Patent Application No. PCT/US2016/35500.
Jiang et al., Chapter III Seeds and Seedlings, Botany, Northwest A&F University Press, pp. 87-92 (2009).
Kim et al., "Synthesis and characterization of mannosylated pegylated polyethylenimine as a carrier for siRNA," *International Journal of Pharmaceutics*, 427:123-133 (2012).
Kirkwood, "Recent developments in our understanding of the plant cuticle as a barrier to the foliar uptake of pesticides," *Pestic Sci*, 55:69-77 (1999).
Li et al., "A Simplified Seed Transformation Method for Obtaining Transgenic *Brassica napus* Plants," *Agricultural Sciences in China*, 8(6):658-663 (2009).
Li et at., "Long dsRNA but not siRNA initiates RNAi in western corn rootworm larvae and adults," *Journal of Applied Entomology*, 139(6):432-445 (2015).
Liu et al, "The Helicase and RNaseIIIa Domains of *Arabidopsis* Dicer-Like1 Modulate Catalytic Parameters during MicroRNA Biogenesis," *Plant Physiology*, 159:748-758 (2012).
Liu, "Calmodulin and Cell Cycle," *Foreign Medical Sciences Section of Pathophysiology and Clinical Medicine*, 18(4):322-324 (1998).
Liu, "Confocal laser scanning microscopy—an attractive tool for studying the uptake of xenobiotics into plant foliage," *Journal of Microscopy*, 213(Pt 2):87-93 (2004).
Liu, "The Transformation of Nucleic Acid Degradants in Plants," China Organic Fertilizers, Agriculture Press, ISBN: 7-1091634 (1991) (with English translation).
Lodish et al., Molecular Cell Biology, Fourth Edition, p. 210 (2000).
Lucas et al., "Plasmodesmata—bridging the gap between neighboring plant cells," Trends in Cell Biology, 19:495-503 (2009).
Morozov et al., "Evaluation of Preemergence Herbicides for Control of Diclofop-resistant Italian Ryegrass (*Lolium multiflorum*) in Virginia," Virginia Polytechnic Institute and State University, pp. 43-71 (2004).
Nemeth, "Virus, mycoplasma and rickettsia diseases of fruit trees," Martinus Nijhoff Publishers, 197-204 (1986).
N-TER Nanoparticle siRNA, Sigma Aldrich TM website, Web. Nov. 20, 2018.
Office Action dated Aug. 9, 2018, in Canadian Patent Application No. 2,848,371.
Office Action dated Jul. 30, 2018, in Canadian Patent Application No. 2,848,576.
Office Action dated Sep. 20, 2018, in Chilean Patent Application No. 201601440 (with English translation).
Partial European Search Report dated Jun. 29, 2018, in European Patent Application No. 18157745.3.
Partial Supplementary European Search Report dated Jan. 11, 2018, in European Patent Application No. 15812530.2.
Powles et al., "Evolution in Action: Plants Resistant to Herbicides," *Annual Review of Plant Biology*, 61(1):317-347 (2010).
Pratt et al., "Sorghum Expressed Sequence Tags Identify Signature Genes for Drought, Pathogenesis, and Skotomorphogenesis from a Milestone Set of 16,801 Unique Transcripts," *Plant Physiology*, 139:869-884 (2005).
Qi et al., "RNA processing enables predictable programming of gene expression," *Nature Biotechnology*, 30:1002-1007 (2012).
Riar et al., "Glyphosate Resistance in a Johnsongrass (*Sorghum halepense*) Biotype from Arkansas," *Weed Science*, 59:299-304 (2011).
Simeoni et al., "Insight into the mechanism of the peptide-based gene delivery system MPG: implications for delivery of siRNA into mammalian cells," Nucleic Acids Research, 31(11):2717-2724 (2003).
Small, "RNAi for revealing and engineering plant gene functions," *Current Opinion in Biotechnology*, 18:148-153 (2007).
Swarts et al., "Argonaute of the archaeon Pyrococcus furiosus is a DNA-guided nuclease that targets cognate DNA," *Nucleic Acid Res.*, 43(10):5120-5129 (2015).
Swarts et al., "DNA-guided DNA interference by a prokaryotic Argonaute," *Nature*, 507(7491):258-61 (2014).

(56) References Cited

OTHER PUBLICATIONS

Tice, "Selecting the right compounds for screening: does Lipinski's Rule of 5 for pharmaceuticals apply to agrochemicals?" Pest Management Science, 57(1):3-16 (2001).

Toriyama et al., "Transgenic Rice Plants After Direct Gene Transfer Into Protoplasts," BioTechnology, 6:1072-1074 (1988).

Townsend et al., "High frequency modification of plant genes using engineered zinc finger nucleases," Nature, 459:442-445 (2009).

TransIT-TKO© Transfection Reagent, Frequently Asked Questions, Web. 2019.

Trucco et al., "Amaranthus hybridus can be pollinated frequently by A. tuberculatus under filed conditions," Heredity, 94:64-70 (2005).

Van der Meer et al., "Promoted analysis of the chalcone synthase (chs A) gene of Petunia hybrid: a 67 bp promoter region directs flower-specific expression," Plant Mol. Biol., 15:95-109 (1990).

Vila-Aiub et al., "Glyphosate resistance in perennial Sorghum halepense (Johnsongrass), endowed by reduced glyphosate translocation and leaf uptake," Pest Manag Sci., 68:430-436 (2012).

Watson et al., "RNA silencing platforms in plants," FEBS Letters, 579:5982-5987 (2005).

Wiesman et al., "Novel cationic vesicle platform derived from vernonia oil for efficient delivery of DNA through plant cuticle membranes," Journal of Biotechnology, 130:85-94 (2007).

Yan et al., Seed Science, China Agriculture Press, pp. 101-103, Tables 2-37 (2001).

Yu et al., "Diversity of Acetyl-Coenzyme A Carboxylase Mutations in Resistant Lolium Populations: Evaluation Using Clethodim," Plant Physiology, 145:547-558 (2007).

Yu et al., "Glyphosate, paraquat and ACCase multiple herbicide resistance evolved in a Lolium rigidum biotype," Planta, 225:499-513 (2007).

Zabkiewicz, "Adjuvants and herbicidal efficacy—present status and future prospects," Weed Research, 40:139-149 (2000).

Zhang et al., "Development and Validation of Endogenous Reference Genes for Expression Profiling of Medaka (Oryzias latipes) Exposed to Endocrine Disrupting Chemicals by Quantitative Real-Time RT-PCR," Toxicological Sciences, 95(2):356-368 (2007).

Zhang, "Artificial trans-acting small interfering RNA: a tool for plant biology study and crop improvements," Planta, 239:1139-1146 (2014).

Zhao et al., "Ps0r1, a potential target for RNA interference-based pest management," Insect Molecular Biology, 20(1):97-104 (2011).

Zhao et al., "Vegetable Standardized Production Technology," Hangzhou: Zhejiang Science and Technology Press, p. 19 (2008).

Zidack et al., "Promotion of Bacterial Infection of Leaves by an Organosilicone Surfactant: Implications for Biological Weed Control," Biological Control, 2:111-117 (1992).

Zipperian et al., "Silicon Carbide Abrasive Grinding," Quality Matters Newsletter, PACE Technologies, 1(2):1-3 (2002).

Andersen et al., "Delivery of siRNA from lyophilized polymeric surfaces," Biomaterials, 29:506-512 (2008).

Baker, "Chlorophyll Fluorescence: A Probe of Photosynthesis in Vivo," Annu. Rev. Plant Biol., 59:89-113 (2008).

Brugiere et al., "Glutamine Synthetase in the Phloem Plays a Major Role in Controlling Proline Production," The Plant Cell, 11:195-2011 (1999).

Burleigh, "Relative quantitative RT-PCR to study the expression of plant nutrient transporters in arbuscular mycorrhizas," Plant Science, 160:899-904 (2001).

Chang et al., "Dual-target gene silencing by using long, synthetic siRNA duplexes without triggering antiviral responses," Molecules and Cells, 27(6):689-695 (2009).

Communication pursuant to Article 94(3) EPC dated Mar. 16, 2020, in European Patent Application No. 17194281.6.

Communication pursuant to Article 94(3) EPC dated Mar. 27, 2020, in European Patent Application No. 15811092.4.

Danka et al., "Field Test of Resistance to Acarapis woodi (Acari: Tarsonemidae) and of Colony Production by Four Stocks of Honey Bees (Hymenoptera: Apidae)" Journal of Economic Entomology, 88(3):584-591 (1995).

Decision to Grant dated Feb. 24, 2020, in Ukrainian Patent Application No. A 2016 08743 (with English language translation).

Declaration of Professor Robert James Henry executed Mar. 1, 2018, as filed by Applicant in Australian Patent Application No. 2014262189, pp. 1-119.

Downey et al., "Single and dual parasitic mite infestations on the honey bee, Apis mellifera L.," Insectes Sociaux, 47(2):171-176 (2000).

Extended European Search Report dated Mar. 25, 2020, in European Patent Application No. 19192942.1.

Gilmer et al., "Latent Viruses of Apple I. Detection with Woody Indicators," Plant Pathology, 1(10):1-9 (1971).

Hwa et al., "Fixation of hybrid vigor in rice: opportunities and challenges," Euphytica, 160:287-293 (2008).

Jasieniuk et al., "Glyphosate-Resistant Italian Ryegrass (Lolium multiflorum) in California: Distribution, Response to Glyphosate, and Molecular Evidence for an Altered Target Enzyme," Weed Science, 56(4):496-502 (2008).

Khanbekova et al., The defeat of the honey bee apis melifera caucasica Gorb. By viruses and parasites, and condition of bee colonies in different ecogeographical conditions of Greater Caucasus, Agricultural Biology. 2013 (p. 43) (in Russian).

Office Action dated Feb. 20, 2020, in Canadian Patent Application No. 2,905,104.

Office Action dated Feb. 25, 2020, in Japanese Patent Application No. 2017-538699 (with English language translation).

Ossowski et al., "Gene silencing in plants using artificial microRNAs and other small RNAs," The Plant Journal, 53:674-690 (2008).

Partial European Search Report dated Dec. 6, 2019, in European Patent Application No. 19185431.4.

Prado et al., "Design and optimization of degenerated universal primers for the doing of the plant acetolactate synthase conserved domains," Weed Science, 52:487-491 (2004).

Regalado, "The Next Great GMO Debate," MIT Technology Review, pp. 1-19 (2015) <https://www.technologyreview.com/s/540136/the-next-great-gmo-debate/>.

Sammataro et al., "Some Volatile Plant Oils as Potential Control Agents for Varroa Mites (Acari: Varroidae) in Honey Bee Colonies (Hymenoptera: Apidae)," American Bee Journal, 138(9):681-685 (1998).

Subramoni et al., "Lipases as Pathogenicity Factors of Plant Pathogens," Handbook of Hydrocarbon and Lipid Microbiology, 3269-3277 (2010).

Sun, "Characterization of Organosilicone Surfactants and Their Effects on Sulfonylurea Herbicide Activity," Thesis Submitted to the Faculty of the Virginia Polytechnic Institute and State University dated Apr. 5, 1996.

Tenllado et al., "Crude extracts of bacterially expressed dsRNA can be used to protect plants against virus infections," BMC Biotechnology, 3:1-11 (2003).

TransIT-TKO® Transfection Reagent, Frequently Asked Questions, Web. 2019 <https://www.mirusbio.com/tech-resources/fags/transit-tko-faqs>.

Walton, "Deconstructing the Cell Wall," Plant Physiol., 104:1113-1118 (1994).

Wang et al., "Principle and technology of genetic engineering in plants," in Plant genetic engineering principles and techniques, Beijing: Science Press, pp. 313-315 (1998).

Wild Carrot, Noxious Weed Control Board (NWCB) of Washington State (2010) <www.nwcb.wa.gov/detail.asp?weed=46>.

Yibrah et al.," Antisense RNA inhibition of uidA gene expression in transgenic plants: Evidence for interaction between first and second transformation events," Hereditas, 118:273-280 (1993)

\* cited by examiner ssDNA-PDS fb Norflurazon

Buffer      ssDNA-PDS      ssDNA-PDS      Norflurazon
                                         fb Norflurazon

METHODS AND COMPOSITIONS FOR WEED CONTROL

This application claims benefit under 35USC § 119(e) of U.S. provisional application Ser. No. 61/534,082 filed Sep. 13, 2011, herein incorporated by reference in it's entirety. The sequence listing that is contained in the file named "40_21(58639)B seq listing.txt", which is 1,035,201 bytes (measured in operating system MS-Windows) and was created on 5 Sep. 2012, is filed herewith and incorporated herein by reference.

FIELD

The methods and compositions generally relate to the field of weed management. More specifically, related to phytoene desaturase (PDS) genes in plants and compositions containing polynucleotide molecules for modulating their expression. Further provided are methods and compositions useful for weed control.

BACKGROUND

Weeds are plants that compete with cultivated plants in an agronomic environment and cost farmers billions of dollars annually in crop losses and the expense of efforts to keep weeds under control. Weeds also serve as hosts for crop diseases and insect pests. The losses caused by weeds in agricultural production environments include decreases in crop yield, reduced crop quality, increased irrigation costs, increased harvesting costs, reduced land value, injury to livestock, and crop damage from insects and diseases harbored by the weeds. The principal means by which weeds cause these effects are: 1) competing with crop plants for water, nutrients, sunlight and other essentials for growth and development, 2) production of toxic or irritant chemicals that cause human or animal health problem, 3) production of immense quantities of seed or vegetative reproductive parts or both that contaminate agricultural products and perpetuate the species in agricultural lands, and 4) production on agricultural and nonagricultural lands of vast amounts of vegetation that must be disposed of. Herbicide tolerant weeds are a problem with nearly all herbicides in use, there is a need to effectively manage these weeds. There are over 365 weed biotypes currently identified as being herbicide resistant to one or more herbicides by the Herbicide Resistance Action Committee (HRAC), the North American Herbicide Resistance Action Committee (NAHRAC), and the Weed Science Society of America (WSSA).

The phytoene desaturase (PDS) enzyme is an essential enzyme in the carotenoid biosysnthesis pathway. This enzyme is the target of herbicides that include Pyridazinones, Pyridinecarboxamides, beflubutamid, fluridone, fluorochloridone and flurtamone.

BRIEF DESCRIPTION OF THE FIGURES

The following drawings form part of the present specification and are included to further demonstrate certain aspects of the present invention. The invention may be better understood by reference to one or more of these drawings in combination with the detailed description of specific embodiments presented herein. The invention can be more fully understood from the following description of the figures.

SUMMARY

Figure 1:
FIG. 1. Treatment of *Amaranthus palmeri* with ssDNA trigger polynucleotides and PDS inhibitor herbicide, norflurazon.
Figure 2:
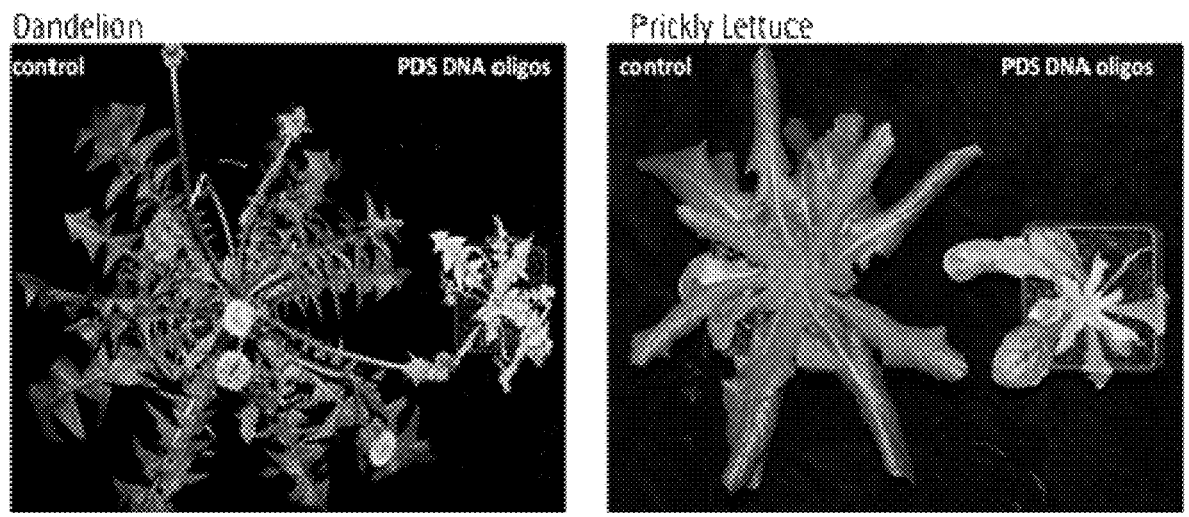
FIG. 2. Dandelion and Prickly lettuce treated with PDS ssDNA oligonucleotides

In one aspect, the invention provides a method of plant control comprising an external application to a plant of a composition comprising a polynucleotide and a transfer agent, wherein the polynucleotide is essentially identical or essentially complementary to a PDS gene sequence or fragment thereof, or to the RNA transcript of said PDS gene sequence or fragment thereof, wherein said PDS gene sequence is selected from the group consisting of SEQ ID NO:1-78 and 2138 or a polynucleotide fragment thereof, whereby the plant growth or development or reproductive ability is reduced or the plant is made more sensitive to a PDS inhibitor herbicide relative to a plant not treated with said composition. In this manner, plants that have become resistant to the application of PDS containing herbicides may be made more susceptible to the herbicidal effects of a PDS inhibitor containing herbicide, thus potentiating the effect of the herbicide. The polynucleotide fragment is at least 18 contiguous nucleotides, at least 19 contiguous nucleotides, at least 20 contiguous nucleotides or at least 21 contiguous nucleotides in length and at least 85 percent identical to a PDS gene sequence selected from the group consisting of SEQ ID NO:1-78 and 2138 and the transfer agent is an organosilicone composition or compound. The polynucleotide fragment can also be sense or anti-sense ssDNA or ssRNA, dsRNA, or dsDNA, or dsDNA/RNA hybrids. The composition can include more than one polynucleotide fragments, and the composition can include a PDS inhibitor herbicide and/or other herbicides (co-herbicides) that enhance the plant control activity of the composition.

In another aspect, polynucleotide molecules and methods for modulating PDS gene expression in plant species are provided. The method reduces, represses or otherwise delays expression of a PDS gene in a plant comprising an external application to such plant of a composition comprising a polynucleotide and a transfer agent, wherein the polynucleotide is essentially identical or essentially complementary to a PDS gene sequence or fragment thereof, or to the RNA transcript of the PDS gene sequence or fragment thereof, wherein the PDS gene sequence is selected from the group consisting of SEQ ID NO:1-78 and 2138 or a polynucleotide fragment thereof. The polynucleotide fragment is at least 18 contiguous nucleotides, at least 19 contiguous nucleotides, at least 20 contiguous nucleotides at least 21 contiguous nucleotides in length and at least 85 percent identical to a PDS gene sequence selected from the group consisting of SEQ ID NO:1-78 and 2138 and the transfer agent is an organosilicone compound. The polynucleotide fragment can also be sense or anti-sense ssDNA or ssRNA, dsRNA, or dsDNA, or dsDNA/RNA hybrids. Polynucleotide molecules comprising SEQ ID NOs 79-2010 are fragments of the PDS gene.

In a further aspect, the polynucleotide molecule containing composition may be combined with other herbicidal (co-herbicides) compounds to provide additional control of unwanted plants in a field of cultivated plants.

In a further aspect, the polynucleotide molecule composition may be combined with any one or more additional agricultural chemicals, such as, insecticides, fungicides, nematocides, bactericides, acaricides, growth regulators, chemosterilants, semiochemicals, repellents, attractants, pheromones, feeding stimulants, biopesticides, microbial pesticides or other biologically active compounds to form a multi-component pesticide giving an even broader spectrum of agricultural protection.

DETAILED DESCRIPTION

Provided are methods and compositions containing a polynucleotide that provide for regulation, repression or delay of PDS (phytoene desaturase) gene expression and enhanced control of weedy plant species and importantly PDS inhibitor resistant weed biotypes. Aspects of the method can be applied to manage various weedy plants in agronomic and other cultivated environments.

The following definitions and methods are provided to better define the present invention and to guide those of ordinary skill in the art in the practice of the present invention. Unless otherwise noted, terms are to be understood according to conventional usage by those of ordinary skill in the relevant art. Where a term is provided in the singular, the inventors also contemplate aspects of the invention described by the plural of that term.

By "non-transcribable" polynucleotides is meant that the polynucleotides do not comprise a complete polymerase II transcription unit. As used herein "solution" refers to homogeneous mixtures and non-homogeneous mixtures such as suspensions, colloids, micelles, and emulsions.

Weedy plants are plants that compete with cultivated plants, those of particular importance include, but are not limited to important invasive and noxious weeds and herbicide resistant biotypes in crop production, such as, *Amaranthus* species—*A. albus, A. blitoides, A. hybridus, A. palmeri, A. powellii, A. retroflexus, A. spinosus, A. tuberculatus*, and *A. viridis; Ambrosia* species—*A. trifida, A. artemisifolia; Lolium* species—*L. multiflorum, L. rigidium, L perenne; Digitaria* species—*D. insularis; Euphorbia* species—*E. heterophylla; Kochia* species—*K. scoparia; Sorghum* species—*S. halepense; Conyza* species—*C. bonariensis, C. canadensis, C. sumatrensis; Chloris* species—*C. truncate; Echinochola* species—*E. colona, E. crus-galli; Eleusine* species—*E. indica; Poa* species—*P. annua; Plantago* species—*P. lanceolata; Avena* species—*A. fatua; Chenopodium* species—*C. album; Setaria* species—*S. viridis, Abutilon theophrasti, Ipomoea* species, *Sesbania*, species, *Cassia* species, *Sida* species, *Brachiaria*, species and *Solanum* species.

Additional weedy plant species found in cultivated areas include *Alopecurus myosuroides, Avena sterilis, Avena sterilis ludoviciana, Brachiaria plantaginea, Bromus diandrus, Bromus rigidus, Cynosurus echinatus, Digitaria ciliaris, Digitaria ischaemum, Digitaria sanguinalis, Echinochloa oryzicola, Echinochloa phyllopogon, Eriochloa punctata, Hordeum glaucum, Hordeum leporinum, Ischaemum rugosum, Leptochloa chinensis, Lolium persicum, Phalaris minor, Phalaris paradoxa, Rottboellia exalta, Setaria faberi, Setaria viridis var, robusta-alba schreiber, Setaria viridis var, robusta-purpurea, Snowdenia polystachea, Sorghum sudanese, Alisma plantago-aquatica, Amaranthus lividus, Amaranthus quitensis, Ammania auriculata, Ammania coccinea, Anthemis cotula, Apera spica-venti, Bacopa rotundifolia, Bidens pilosa, Bidens subalternans, Brassica tournefortii, Bromus tectorum, Camelina microcarpa, Chrysanthemum coronarium, Cuscuta campestris, Cyperus difformis, Damasonium minus, Descurainia sophia, Diplotaxis tenuifolia, Echium plantagineum, Elatine triandra var, pedicellate, Euphorbia heterophylla, Fallopia convolvulus, Fimbristylis miliacea, Galeopsis tetrahit, Galium spurium, Helianthus annuus, Iva xanthifolia, Ixophorus unisetus, Ipomoea indica, Ipomoea purpurea, Ipomoea sepiaria, Ipomoea aquatic, Ipomoea triloba, Lactuca serriola, Limnocharis flava, Limnophila erecta, Limnophila sessiliflora, Lindernia dubia, Lindernia dubia var, major, Lindernia micrantha, Lindernia procumbens, Mesembryanthemum crystallinum, Monochoria korsakowii, Monochoria vaginalis, Neslia paniculata, Papaver rhoeas, Parthenium hysterophorus, Pentzia suffruticosa, Phalaris minor, Raphanus raphanistrum, Raphanus sativus, Rapistrum rugosum, Rotala indica var, uliginosa, Sagittaria guyanensis, Sagittaria montevidensis, Sagittaria pygmaea, Salsola iberica, Scirpus juncoides var, ohwianus, Scirpus mucronatus, Setaria lutescens, Sida spinosa, Sinapis arvensis, Sisymbrium orientale, Sisymbrium thellungii, Solanum ptycanthum, Sonchus aspen, Sonchus oleraceus, Sorghum bicolor, Stellaria media, Thlaspi arvense, Xanthium strumarium, Arctotheca calendula, Conyza sumatrensis, Crassocephalum crepidiodes, Cuphea carthagenensis, Epilobium adenocaulon, Erigeron philadelphicus, Landoltia punctata, Lepidium virginicum, Monochoria korsakowii, Solanum americanum, Solanum nigrum, Vulpia bromoides, Youngia japonica, Hydrilla verticillata, Carduus nutans, Carduus pycnocephalus, Centaurea solstitialis, Cirsium arvense, Commelina diffusa, Convolvulus arvensis, Daucus carota, Digitaria ischaemum, Echinochloa crus-pavonis, Fimbristylis miliacea, Galeopsis tetrahit, Galium spurium, Limnophila erecta, Matricaria perforate, Papaver rhoeas, Ranunculus acris, Soliva sessilis, Sphenoclea zeylanica, Stellaria media, Nassella trichotoma, Stipa neesiana, Agrostis stolonifera, Polygonum aviculare, Alopecurus japonicus, Beckmannia syzigachne, Bromus tectorum, Chloris inflate, Echinochloa erecta, Portulaca oleracea*, and *Senecio vulgaris*. It is believed that all plants contain a phytoene desaturase gene in their genome, the sequence of which can be isolated and polynucleotides made according to the methods of the present invention that are useful for regulation, suppressing or delaying the expression of the target PDS gene in the plants and the growth or development of the treated plants.

Some cultivated plants may also be weedy plants when they occur in unwanted environments. For example, corn plants growing in a soybean field. Transgenic crops with one or more herbicide tolerances will need specialized methods of management to control weeds and volunteer crop plants.

A "trigger" or "trigger polynucleotide" is a polynucleotide molecule that is homologous or complementary to a target gene polynucleotide. The trigger polynucleotide molecules modulate expression of the target gene when topically applied to a plant surface with a transfer agent, whereby a plant treated with said composition has its growth or development or reproductive ability regulated, suppressed or delayed or said plant is more sensitive to a PDS inhibitor herbicide as a result of said polynucleotide containing composition relative to a plant not treated with a composition containing the trigger molecule. Trigger polynucleotides disclosed herein are generally described in relation to the target gene sequence and maybe used in the sense (homologous) or antisense (complementary) orientation as single stranded molecules or comprise both strands as double stranded molecules or nucleotide variants and modified nucleotides thereof depending on the various regions of a gene being targeted.

It is contemplated that the composition will contain multiple polynucleotides and herbicides that include but not limited to PDS gene trigger polynucleotides and a PDS inhibitor herbicide and anyone or more additional herbicide target gene trigger polynucleotides and the related herbicides and anyone or more additional essential gene trigger polynucleotides. Essential genes are genes in a plant that provide key enzymes or other proteins, for example, a biosynthetic enzyme, metabolizing enzyme, receptor, signal transduction protein, structural gene product, transcription factor, or transport protein; or regulating RNAs, such as, microRNAs, that are essential to the growth or survival of the organism or cell or involved in the normal growth and development of the plant (Meinke, et al., Trends Plant Sci. 2008 September; 13(9):483-91). The suppression of an essential gene enhances the effect of a herbicide that affects the function of a gene product different than the suppressed essential gene. The compositions of the present invention can include various trigger polynucleotides that modulate the expression of an essential gene other than a PDS gene.

Herbicides for which transgenes for plant tolerance have been demonstrated and the method of the present invention can be applied, include but are not limited to: auxin-like herbicides, glyphosate, glufosinate, sulfonylureas, imidazolinones, bromoxynil, delapon, dicamba, cyclohezanedione, protoporphyrionogen oxidase inhibitors, 4-hydroxyphenyl-pyruvate-dioxygenase inhibitors herbicides. For example, transgenes and their polynucleotide molecules that encode proteins involved in herbicide tolerance are known in the art, and include, but are not limited to an 5-enolpyruvylshikimate-3-phosphate synthase (EPSPS), for example, as more fully described in U.S. Pat. No. 7,807,791 (SEQ ID NO:5); U.S. Pat. Nos. 6,248,876 B1; 5,627,061; 5,804,425; 5,633,435; 5,145,783; 4,971,908; 5,1062,910; 5,188,642; 4,940,835; 5,866,775; 6,225,114 B1; 6,130,366; 5,1060,667; 4,535,060; 4,769,061; 5,633,448; 5,510,471; U.S. Pat. No. Re. 36,449; U.S. Pat. Nos. RE 37,287 E; and 5,491,288; tolerance to sulfonylurea and/or imidazolinone, for example, as described more fully in U.S. Pat. Nos. 5,605,011; 5,013,659; 5,141,870; 5,767,361; 5,7106,180; 5,304,732; 4,761,373; 5,3106,107; 5,928,937; and 5,378,824; and international publication WO 96/33270; tolerance to hydroxyphenylpyruvatedioxygenases inhibiting herbicides in plants are described in U.S. Pat. Nos. 6,245,968 B1; 6,268,549; and 6,069,115; US Pat. Pub. 20110191897 and U.S. Pat. No. 7,1062,379 SEQ ID NO:3; U.S. Pat. Nos. 7,935,869; 7,304,209, SEQ ID NO:1, 3, 5 and 15; aryloxyalkanoate dioxygenase polynucleotides, which confer tolerance to 2,4-D and other phenoxy auxin herbicides as well as to aryloxyphenoxypropionate herbicides as described, for example, in WO2005/107437; U.S. Pat. No. 7,838,733 SEQ ID NO:5) and dicamba-tolerance polynucleotides as described, for example, in Herman et al. (2005) J. Biol. Chem. 280: 24759-24767. Other examples of herbicide-tolerance traits include those conferred by polynucleotides encoding an exogenous phosphinothricin acetyltransferase, as described in U.S. Pat. Nos. 5,969,213; 5,489,520; 5,550,1068; 5,874,265; 5,919,675; 5,561,236; 5,648,477; 5,646,024; 6,177,616; and 5,879,903. Plants containing an exogenous phosphinothricin acetyltransferase can exhibit improved tolerance to glufosinate herbicides, which inhibit the enzyme glutamine synthase. Additionally, herbicide-tolerance polynucleotides include those conferred by polynucleotides conferring altered protoporphyrinogen oxidase (protox) activity, as described in U.S. Pat. Nos. 6,288,306 B1; 6,282,837 B1; and 5,767,373; and WO 01/12825. Plants containing such polynucleotides can exhibit improved tolerance to any of a variety of herbicides which target the protox enzyme (also referred to as protox inhibitors). Polynucleotides encoding a glyphosate oxidoreductase and a glyphosate-N-acetyl transferase (GOX described in U.S. Pat. No. 5,463,175 and GAT described in U.S. Patent publication 20030083480, dicamba monooxygenase U.S. Patent publication 20030135879, all of which are incorporated herein by reference); a polynucleotide molecule encoding bromoxynil nitrilase (Bxn described in U.S. Pat. No. 4,810,648 for Bromoxynil tolerance, which is incorporated herein by reference); a polynucleotide molecule encoding phytoene desaturase (crtI) described in Misawa et al, (1993) *Plant J.* 4:833-840 and Misawa et al, (1994) *Plant J.* 6:481-489 for norflurazon tolerance; a polynucleotide molecule encoding acetohydroxyacid synthase (AHAS, aka ALS) described in Sathasiivan et al. (1990) *Nucl. Acids Res.* 18:1068-2193 for tolerance to sulfonylurea herbicides; and the bar gene described in DeBlock, et al. (1987) *EMBO J.* 6:2513-2519 for glufosinate and bialaphos tolerance. The transgenic coding regions and regulatory elements of the herbicide tolerance genes are targets in which polynucleotide triggers and herbicides can be included in the composition of the present invention.

PDS inhibitor herbicides include but are not limited to norflurazon, diflufenican, picolinafen, beflubutamid, fluridone, fluorochloridone and flurtamone.

Numerous herbicides with similar or different modes of action (herein referred to as co-herbicides) are available that can be added to the composition of the present invention, for example, members of the herbicide families that include but are not limited to amide herbicides, aromatic acid herbicides, arsenical herbicides, benzothiazole herbicides, benzoylcyclohexanedione herbicides, benzofuranyl alkylsulfonate herbicides, carbamate herbicides, cyclohexene oxime herbicides, cyclopropylisoxazole herbicides, dicarboximide herbicides, dinitroaniline herbicides, dinitrophenol herbicides, diphenyl ether herbicides, dithiocarbamate herbicides, halogenated aliphatic herbicides, imidazolinone herbicides, inorganic herbicides, nitrile herbicides, organophosphorus herbicides, oxadiazolone herbicides, oxazole herbicides, phenoxy herbicides, phenylenediamine herbicides, pyrazole herbicides, pyridazine herbicides, pyridazinone herbicides, pyridine herbicides, pyrimidinediamine herbicides, pyrimidinyloxybenzylamine herbicides, quaternary ammonium herbicides, thiocarbamate herbicides, thiocarbonate herbicides, thiourea herbicides, triazine herbicides, triazinone herbicides, triazole herbicides, triazolone herbicides, triazolopyrimidine herbicides, uracil herbicides, and urea herbicides. In particular, the rates of use of the added herbicides can be reduced in compositions comprising the polynucleotides of the invention. Use rate reductions of the additional added herbicides can be 10-25 percent, 26-50 percent, 51-75 percent or more can be achieved that enhance the activity of the polynucleotides and herbicide composition and is contemplated as an aspect of the invention. Representative co-herbicides of the families include but are not limited to acetochlor, acifluorfen, acifluorfen-sodium, aclonifen, acrolein, alachlor, alloxydim, allyl alcohol, ametryn, amicarbazone, amidosulfuron, aminopyralid, amitrole, ammonium sulfamate, anilofos, asulam, atraton, atrazine, azimsulfuron, BCPC, beflubutamid, benazolin, benfluralin, benfuresate, bensulfuron, bensulfuron-methyl, bensulide, bentazone, benzfendizone, benzobicyclon, benzofenap, bifenox, bilanafos, bispyribac, bispyribac-sodium, borax, bromacil, bromobutide, bromoxynil, butachlor, butafenacil, butamifos, butralin, butroxydim, butylate, cacodylic acid, calcium chlorate, cafenstrole, carbetamide, carfentrazone, carfentrazone-ethyl, CDEA, CEPC, chlorflurenol, chlorflurenol-methyl, chloridazon, chlorimuron, chlorimuron-ethyl, chloroacetic acid, chlorotoluron, chlorpropham, chlorsulfuron, chlorthal, chlorthal-dimethyl, cinidon-ethyl, cinmethylin, cinosulfuron, cisanilide, clethodim, clodinafop, clodinafop-propargyl, clomazone, clomeprop, clopyralid, cloransulam, cloransulam-methyl, CMA, 4-CPB, CPMF, 4-CPP, CPPC, cresol, cumyluron, cyanamide, cyanazine, cycloate, cyclosulfamuron, cycloxydim, cyhalofop, cyhalofop-butyl, 2,4-D, 3,4-DA, daimuron, dalapon, dazomet, 2,4-DB, 3,4-DB, 2,4-DEB, desmedipham, dicamba, dichlobenil, ortho-dichlorobenzene, para-dichlorobenzene, dichlorprop, dichlorprop-P, diclofop, diclofop-methyl, diclosulam, difenzoquat, difenzoquat metilsulfate, diflufenican, diflufenzopyr, dimefuron, dimepiperate, dimethachlor, dimethametryn, dimethenamid, dimethenamid-P, dimethipin, dimethylarsinic acid, dinitramine, dinoterb, diphenamid, diquat, diquat dibromide, dithiopyr, diuron, DNOC, 3,4-DP, DSMA, EBEP, endothal, EPTC, esprocarb, ethalfluralin, ethametsulfuron, ethametsulfuron-methyl, ethofumesate, ethoxyfen, ethoxysulfuron, etobenzanid, fenoxaprop-P, fenoxaprop-P-ethyl, fentrazamide, ferrous sulfate, flamprop-M, flazasulfuron, florasulam, fluazifop, fluazifop-butyl, fluazifop-P, fluazifop-P-butyl, flucarbazone, flucarbazone-sodium, flucetosulfuron, fluchloralin, flufenacet, flufenpyr, flufenpyr-ethyl, flumetsulam, flumiclorac, flumiclorac-pentyl, flumioxazin, fluometuron, fluoroglycofen, fluoroglycofen-ethyl, flupropanate, flupyrsulfuron, flupyrsulfuron-methyl-sodium, flurenol, fluridone, fluorochloridone, fluoroxypyr, flurtamone, fluthiacet, fluthiacet-methyl, fomesafen, foramsulfuron, fosamine, glufosinate, glufosinate-ammonium, glyphosate, halosulfuron, halosulfuron-methyl, haloxyfop, haloxyfop-P, HC-252, hexazinone, imazamethabenz, imazamethabenz-methyl, imazamox, imazapic, imazapyr, imazaquin, imazethapyr, imazosulfuron, indanofan, iodomethane, iodosulfuron, iodosulfuron-methyl-sodium, ioxynil, isoproturon, isouron, isoxaben, isoxachlortole, isoxaflutole, karbutilate, lactofen, lenacil, linuron, MAA, MAMA, MCPA, MCPA-thioethyl, MCPB, mecoprop, mecoprop-P, mefenacet, mefluidide, mesosulfuron, mesosulfuron-methyl, mesotrione, metam, metamifop, metamitron, metazachlor, methabenzthiazuron, methylarsonic acid, methyldymron, methyl isothiocyanate, metobenzuron, metolachlor, S-metolachlor, metosulam, metoxuron, metribuzin, metsulfuron, metsulfuron-methyl, MK-66, molinate, monolinuron, MSMA, naproanilide, napropamide, naptalam, neburon, nicosulfuron, nonanoic acid, norflurazon, oleic acid (fatty acids), orbencarb, orthosulfamuron, oryzalin, oxadiargyl, oxadiazon, oxasulfuron, oxaziclomefone, oxyfluorfen, paraquat, paraquat dichloride, pebulate, pendimethalin, penoxsulam, pentachlorophenol, pentanochlor, pentoxazone, pethoxamid, petrolium oils, phenmedipham, phenmedipham-ethyl, picloram, picolinafen, pinoxaden, piperophos, potassium arsenite, potassium azide, pretilachlor, primisulfuron, primisulfuron-methyl, prodiamine, profluazol, profoxydim, prometon, prometryn, propachlor, propanil, propaquizafop, propazine, propham, propisochlor, propoxycarbazone, propoxycarbazone-sodium, propyzamide, prosulfocarb, prosulfuron, pyraclonil, pyraflufen, pyraflufen-ethyl, pyrazolynate, pyrazosulfuron, pyrazosulfuron-ethyl, pyrazoxyfen, pyribenzoxim, pyributicarb, pyridafol, pyridate, pyriftalid, pyriminobac, pyriminobac-methyl, pyrimisulfan, pyrithiobac, pyrithiobac-sodium, quinclorac, quinmerac, quinoclamine, quizalofop, quizalofop-P, rimsulfuron, sethoxydim, siduron, simazine, simetryn, SMA, sodium arsenite, sodium azide, sodium chlorate, sulcotrione, sulfentrazone, sulfometuron, sulfometuron-methyl, sulfosate, sulfosulfuron, sulfuric acid, tar oils, 2,3,6-TBA, TCA, TCA-sodium, tebuthiuron, tepraloxydim, terbacil, terbumeton, terbuthylazine, terbutryn, thenylchlor, thiazopyr, thifensulfuron, thifensulfuron-methyl, thiobencarb, tiocarbazil, topramezone, tralkoxydim, tri-allate, triasulfuron, triaziflam, tribenuron, tribenuron-methyl, tricamba, triclopyr, trietazine, trifloxysulfuron, triflusulfuron-sodium, trifluralin, triflusulfuron, triflusulfuron-methyl, trihydroxytriazine, tritosulfuron, [3-[2-chloro-4-fluoro-5-(-methyl-6-trifluoromethyl-2,4-dioxo-,2,3,4-tetrahydropyrimidin-3-yl)phenoxy]-2-pyridyloxy]acetic acid ethyl ester (CAS RN 353292-3-6), 4-[(4,5-dihydro-3-methoxy-4-methyl-5-oxo)-H-,2,4-triazol-ylcarbonyl-sulfamoyl]-5-methylthiophene-3-carboxylic acid (BAY636), BAY747 (CAS RN 33504-84-2), topramezone (CAS RN 2063-68-8), 4-hydroxy-3-[[2-[(2-methoxyethoxy)methyl]-6-(trifluoro-methyl)-3-pyridi-nyl]carbonyl]-bicyclo[3.2.] oct-3-en-2-one (CAS RN 35200-68-5), and 4-hydroxy-3-[[2-(3-methoxypropyl)-6-(difluoromethyl)-3-pyridinyl] carbon-yl]-bicyclo[3.2.]oct-3-en-2-one. Additionally, including herbicidal compounds of unspecified modes of action as described in CN101279950A, CN101279951A, DE10000600A1, DE10116399A1, DE102004054666A1, DE102005014638A1, DE102005014906A1, DE102007012168A1, DE102010042866A1, DE10204951A1, DE10234875A1, DE10234876A1, DE10256353A1, DE10256354A1, DE10256367A1, EP1157991A2, EP1238586A1, EP2147919A1, EP2160098A2, JP03968012B2, JP2001253874A, JP2002080454A, JP2002138075A, JP2002145707A, JP2002220389A, JP2003064059A, JP2003096059A, JP2004051628A, JP2004107228A, JP2005008583A, JP2005239675A, JP2005314407A, JP2006232824A, JP2006282552A, JP2007153847A, JP2007161701A, JP2007182404A, JP2008074840A, JP2008074841A, JP2008133207A, JP2008133218A, JP2008169121A, JP2009067739A, JP2009114128A, JP2009126792A, JP2009137851A, US20060111241A1, US20090036311A1, US20090054240A1, US20090215628A1, US20100099561A1, US20100152443A1, US20110105329A1, US20110201501A1, WO2001055066A2, WO2001056975A1, WO2001056979A1, WO2001090071A2, WO2001090080A1, WO2002002540A1, WO2002028182A1, WO2002040473A1, WO2002044173A2, WO2003000679A2, WO2003006422A1, WO2003013247A1, WO2003016308A1, WO2003020704A1, WO2003022051A1, WO2003022831A1, WO2003022843A1, WO2003029243A2, WO2003037085A1, WO2003037878A1, WO2003045878A2, WO2003050087A2, WO2003051823A1, WO2003051824A1, WO2003051846A2, WO2003076409A1, WO2003087067A1, WO2003090539A1, WO2003091217A1, WO2003093269A2, WO2003104206A2, WO2004002947A1, WO2004002981A2, WO2004011429A1, WO2004029060A1, WO2004035545A2, WO2004035563A1, WO2004035564A1, WO2004037787A1, WO2004067518A1, WO2004067527A1, WO2004077950A1, WO2005000824A1, WO2005007627A1, WO2005040152A1, WO2005047233A1, WO2005047281A1, WO2005061443A2, WO2005051464A1, WO2005068434A1, WO2005070889A1, WO2005089551A1, WO2005095335A1, WO2006006569A1, WO2006024820A1, WO2006029828A1, WO2006029829A1, WO2006037945A1, WO2006050803A1, WO2006090792A1,
WO2006123088A2, WO2006125687A1,
WO2006125688A1, WO2007003294A1,
WO2007026834A1, WO2007071900A1,
WO2007077201A1, WO2007077247A1,
WO2007096576A1, WO2007119434A1,
WO2007134984A1, WO2008009908A1,
WO2008029084A1, WO2008059948A1,
WO2008071918A1, WO2008074991A1,
WO2008084073A1, WO2008100426A2,
WO2008102908A1, WO2008152072A2,
WO2008152073A2, WO2009000757A1,
WO2009005297A2, WO2009035150A2,
WO2009063180A1, WO2009068170A2,
WO2009068171A2, WO2009086041A1,
WO2009090401A2, WO2009090402A2,
WO2009115788A1, WO2009116558A1,
WO2009152995A1, WO2009158258A1,
WO2010012649A1, WO2010012649A1,
WO2010026989A1, WO2010034153A1,
WO2010049270A1, WO2010049369A1,
WO2010049405A1, WO2010049414A1,
WO2010063422A1, WO2010069802A1,
WO2010078906A2, WO2010078912A1,
WO2010104217A1, WO2010108611A1,
WO2010112826A3, WO2010116122A3,
WO2010119906A1, WO2010130970A1,
WO2011003776A2, WO2011035874A1,
WO2011065451A1, all of which are incorporated herein by reference.

An agronomic field in need of plant control is treated by application of the composition directly to the surface of the growing plants, such as by a spray. For example, the method is applied to control weeds in a field of crop plants by spraying the field with the composition. The composition can be provided as a tank mix, a sequential treatment of components (generally the polynucleotide containing composition followed by the herbicide), or a simultaneous treatment or mixing of one or more of the components of the composition from separate containers. Treatment of the field can occur as often as needed to provide weed control and the components of the composition can be adjusted to target specific weed species or weed families through utilization of specific polynucleotides or polynucleotide compositions capable of selectively targeting the specific species or plant family to be controlled. The composition can be applied at effective use rates according to the time of application to the field, for example, preplant, at planting, post planting, post harvest. PDS inhibitor herbicides can be applied to a field at rates of 0.5 lb/ac to 5 lb/ac (pounds per acre) or more. The polynucleotides of the composition can be applied at rates of 1 to 30 grams per acre depending on the number of trigger molecules needed for the scope of weeds in the field.

Crop plants in which weed control is needed include but are not limited to, i) corn, soybean, cotton, canola, sugar beet, alfalfa, sugarcane, rice, and wheat; ii) vegetable plants including, but not limited to, tomato, sweet pepper, hot pepper, melon, watermelon, cucumber, eggplant, cauliflower, broccoli, lettuce, spinach, onion, peas, carrots, sweet corn, Chinese cabbage, leek, fennel, pumpkin, squash or gourd, radish, Brussels sprouts, tomatillo, garden beans, dry beans, or okra; iii) culinary plants including, but not limited to, basil, parsley, coffee, or tea; or, iv) fruit plants including but not limited to apple, pear, cherry, peach, plum, apricot, banana, plantain, table grape, wine grape, citrus, avocado, mango, or berry; v) a tree grown for ornamental or commercial use, including, but not limited to, a fruit or nut tree; or, yl) an ornamental plant (e.g., an ornamental flowering plant or shrub or turf grass). The methods and compositions provided herein can also be applied to plants produced by a cutting, cloning, or grafting process (i.e., a plant not grown from a seed) include fruit trees and plants that include, but are not limited to, citrus, apples, avocados, tomatoes, eggplant, cucumber, melons, watermelons, and grapes as well as various ornamental plants.

Pesticidal Mixtures

The polynucleotide compositions may also be used as mixtures with various agricultural chemicals and/or insecticides, miticides and fungicides, pesticidal and biopesticidal agents. Examples include but are not limited to azinphosmethyl, acephate, isoxathion, isofenphos, ethion, etrimfos, oxydemeton-methyl, oxydeprofos, quinalphos, chlorpyrifos, chlorpyrifos-methyl, chlorfenvinphos, cyanophos, dioxabenzofos, dichlorvos, disulfoton, dimethylvinphos, dimethoate, sulprofos, diazinon, thiometon, tetrachlorvinphos, temephos, tebupirimfos, terbufos, naled, vamidothion, pyraclofos, pyridafenthion, pirimiphos-methyl, fenitrothion, fenthion, phenthoate, flupyrazophos, prothiofos, propaphos, profenofos, phoxime, phosalone, phosmet, formothion, phorate, malathion, mecarbam, mesulfenfos, methamidophos, methidathion, parathion, methyl parathion, monocrotophos, trichlorphon, EPN, isazophos, isamidofos, cadusafos, diamidaphos, dichlofenthion, thionazin, fenamiphos, fosthiazate, fosthietan, phosphocarb, DSP, ethoprophos, alanycarb, aldicarb, isoprocarb, ethiofencarb, carbaryl, carbosulfan, xylylcarb, thiodicarb, pirimicarb, fenobucarb, furathiocarb, propoxur, bendiocarb, benfuracarb, methomyl, metolcarb, XMC, carbofuran, aldoxycarb, oxamyl, acrinathrin, allethrin, esfenvalerate, empenthrin, cycloprothrin, cyhalothrin, gamma-cyhalothrin, lambda-cyhalothrin, cyfluthrin, beta-cyfluthrin, cypermethrin, alpha-cypermethrin, zeta-cypermethrin, silafluofen, tetramethrin, tefluthrin, deltamethrin, tralomethrin, bifenthrin, phenothrin, fenvalerate, fenpropathrin, furamethrin, prallethrin, flucythrinate, fluvalinate, flubrocythrinate, permethrin, resmethrin, ethofenprox, cartap, thiocyclam, bensultap, acetamiprid, imidacloprid, clothianidin, dinotefuran, thiacloprid, thiamethoxam, nitenpyram, chlorfluazuron, diflubenzuron, teflubenzuron, triflumuron, novaluron, novifluoron, bistrifluoron, fluazuron, flucycloxuron, flufenoxuron, hexaflumuron, lufenuron, chromafenozide, tebufenozide, halofenozide, methoxyfenozide, diofenolan, cyromazine, pyriproxyfen, buprofezin, methoprene, hydroprene, kinoprene, triazamate, endosulfan, chlorfenson, chlorobenzilate, dicofol, bromopropylate, acetoprole, fipronil, ethiprole, pyrethrin, rotenone, nicotine sulphate, BT (*Bacillus Thuringiensis*) agent, spinosad, abamectin, acequinocyl, amidoflumet, amitraz, etoxazole, chinomethionat, clofentezine, fenbutatin oxide, dienochlor, cyhexatin, spirodiclofen, spiromesifen, tetradifon, tebufenpyrad, binapacryl, bifenazate, pyridaben, pyrimidifen, fenazaquin, fenothiocarb, fenpyroximate, fluacrypyrim, fluazinam, flufenzin, hexythiazox, propargite, benzomate, polynactin complex, milbemectin, lufenuron, mecarbam, methiocarb, mevinphos, halfenprox, azadirachtin, diafenthiuron, indoxacarb, emamectin benzoate, potassium oleate, sodium oleate, chlorfenapyr, tolfenpyrad, pymetrozine, fenoxycarb, hydramethylnon, hydroxy propyl starch, pyridalyl, flufenerim, flubendiamide, flonicamid, metaflumizole, lepimectin, TPIC, albendazole, oxibendazole, oxfendazole, trichlamide, fensulfothion, fenbendazole, levamisole hydrochloride, morantel tartrate, dazomet, metam-sodium, triadimefon, hexaconazole, propiconazole, ipconazole, prochloraz, triflumizole, tebuconazole, epoxiconazole, difenoconazole, flusilazole, triadimenol, cyproconazole, metconazole, fluquinconazole, bitertanol, tetraconazole, triticonazole, flutriafol, penconazole, diniconazole, fenbuconazole, bromuconazole, imibenconazole, simeconazole, myclobutanil, hymexazole, imazalil, furametpyr, thifluzamide, etridiazole, oxpoconazole, oxpoconazole fumarate, pefurazoate, prothioconazole, pyrifenox, fenarimol, nuarimol, bupirimate, mepanipyrim, cyprodinil, pyrimethanil, metalaxyl, mefenoxam, oxadixyl, benalaxyl, thiophanate, thiophanate-methyl, benomyl, carbendazim, fuberidazole, thiabendazole, manzeb, propineb, zineb, metiram, maneb, ziram, thiuram, chlorothalonil, ethaboxam, oxycarboxin, carboxin, flutolanil, silthiofam, mepronil, dimethomorph, fenpropidin, fenpropimorph, spiroxamine, tridemorph, dodemorph, flumorph, azoxystrobin, kresoxim-methyl, metominostrobin, orysastrobin, fluoxastrobin, trifloxystrobin, dimoxystrobin, pyraclostrobin, picoxystrobin, iprodione, procymidone, vinclozolin, chlozolinate, flusulfamide, dazomet, methyl isothiocyanate, chloropicrin, methasulfocarb, hydroxyisoxazole, potassium hydroxyisoxazole, echlomezol, D-D, carbam, basic copper chloride, basic copper sulfate, copper nonylphenolsulfonate, oxine copper, DBEDC, anhydrous copper sulfate, copper sulfate pentahydrate, cupric hydroxide, inorganic sulfur, wettable sulfur, lime sulfur, zinc sulfate, fentin, sodium hydrogen carbonate, potassium hydrogen carbonate, sodium hypochlorite, silver, edifenphos, tolclofos-methyl, fosetyl, iprobenfos, dinocap, pyrazophos, carpropamid, fthalide, tricyclazole, pyroquilon, diclocymet, fenoxanil, kasugamycin, validamycin, polyoxins, blasticiden S, oxytetracycline, mildiomycin, streptomycin, rape seed oil, machine oil, benthiavalicarbisopropyl, iprovalicarb, propamocarb, diethofencarb, fluoroimide, fludioxanil, fenpiclonil, quinoxyfen, oxolinic acid, chlorothalonil, captan, folpet, probenazole, acibenzolar-S-methyl, tiadinil, cyflufenamid, fenhexamid, diflumetorim, metrafenone, picobenzamide, proquinazid, famoxadone, cyazofamid, fenamidone, zoxamide, boscalid, cymoxanil, dithianon, fluazinam, dichlofluanide, triforine, isoprothiolane, ferimzone, diclomezine, tecloftalam, pencycuron, chinomethionat, iminoctadine acetate, iminoctadine albesilate, ambam, polycarbamate, thiadiazine, chloroneb, nickel dimethyldithiocarbamate, guazatine, dodecylguanidine-acetate, quintozene, tolylfluanid, anilazine, nitrothalisopropyl, fenitropan, dimethirimol, benthiazole, harpin protein, flumetover, mandipropamide and penthiopyrad.

Polynucleotides

As used herein, the term "DNA", "DNA molecule", "DNA polynucleotide molecule" refers to a single-stranded DNA (ssDNA) or double-stranded DNA (dsDNA) molecule of genomic or synthetic origin, such as, a polymer of deoxyribonucleotide bases or a DNA polynucleotide molecule. As used herein, the term "DNA sequence", "DNA nucleotide sequence" or "DNA polynucleotide sequence" refers to the nucleotide sequence of a DNA molecule. As used herein, the term "RNA", "RNA molecule", "RNA polynucleotide molecule" refers to a single-stranded RNA (ssRNA) or double-stranded RNA (dsRNA) molecule of genomic or synthetic origin, such as, a polymer of ribonucleotide bases that comprise single or double stranded regions. Unless otherwise stated, nucleotide sequences in the text of this specification are given, when read from left to right, in the 5' to 3' direction. The nomenclature used herein is that required by Title 37 of the United States Code of Federal Regulations § 1.822 and set forth in the tables in WIPO Standard ST.25 (1998), Appendix 2, Tables 1 and 3.

As used herein, "polynucleotide" refers to a DNA or RNA molecule containing multiple nucleotides and generally refers both to "oligonucleotides" (a polynucleotide molecule of typically 50 or fewer nucleotides in length) and polynucleotides of 51 or more nucleotides. Embodiments include compositions including oligonucleotides having a length of 18-25 nucleotides (18-mers, 19-mers, 20-mers, 21-mers, 22-mers, 23-mers, 24-mers, or 25-mers), for example, oligonucleotides SEQ ID NO:2011-2136 or fragments thereof or medium-length polynucleotides having a length of 26 or more nucleotides (polynucleotides of 26, 27, 28, 29, 30, 106, 32, 33, 34, 35, 36, 37, 38, 39, 40, 41, 42, 43, 44, 45, 46, 47, 48, 49, 50, 51, 52, 53, 54, 55, 56, 57, 58, 59, 60, about 65, about 70, about 75, about 80, about 85, about 90, about 95, about 100, about 110, about 120, about 130, about 140, about 150, about 160, about 170, about 180, about 190, about 200, about 210, about 220, about 230, about 240, about 250, about 260, about 270, about 280, about 290, or about 300 nucleotides), for example, oligonucleotides of SEQ ID NO:79-2010 or fragments thereof or long polynucleotides having a length greater than about 300 nucleotides (for example, polynucleotides of between about 300 to about 400 nucleotides, between about 400 to about 500 nucleotides, between about 500 to about 600 nucleotides, between about 600 to about 700 nucleotides, between about 700 to about 800 nucleotides, between about 800 to about 900 nucleotides, between about 900 to about 1000 nucleotides, between about 300 to about 500 nucleotides, between about 300 to about 600 nucleotides, between about 300 to about 700 nucleotides, between about 300 to about 800 nucleotides, between about 300 to about 900 nucleotides, or about 1000 nucleotides in length, or even greater than about 1000 nucleotides in length, for example up to the entire length of a target gene including coding or non-coding or both coding and non-coding portions of the target gene), for example, polynucleotides of Table 1 (SEQ ID NO:1-78) and SEQ ID NO: 2138, wherein the selected polynucleotides or fragments thereof are homologous or complementary to SEQ ID NO:1-78 and 2138 suppresses, represses or otherwise delay the expression of the target PDS gene. A target gene comprises any polynucleotide molecule in a plant cell or fragment thereof for which the modulation of the expression of the target gene is provided by the methods and compositions. Where a polynucleotide is double-stranded, its length can be similarly described in terms of base pairs. Oligonucleotides and polynucleotides can be made that are essentially identical or essentially complementary to adjacent genetic elements of a gene, for example, spanning the junction region of an intron and exon, the junction region of a promoter and a transcribed region, the junction region of a 5' leader and a coding sequence, the junction of a 3' untranslated region and a coding sequence.

Polynucleotide compositions used in the various embodiments include compositions including oligonucleotides or polynucleotides or a mixture of both, including RNA or DNA or RNA/DNA hybrids or chemically modified oligonucleotides or polynucleotides or a mixture thereof. In some embodiments, the polynucleotide may be a combination of ribonucleotides and deoxyribonucleotides, for example, synthetic polynucleotides consisting mainly of ribonucleotides but with one or more terminal deoxyribonucleotides or synthetic polynucleotides consisting mainly of deoxyribonucleotides but with one or more terminal dideoxyribonucleotides. In some embodiments, the polynucleotide includes non-canonical nucleotides such as inosine, thiouridine, or pseudouridine. In some embodiments, the polynucleotide includes chemically modified nucleotides. Examples of chemically modified oligonucleotides or polynucleotides are well known in the art; see, for example, US Patent Publication 20110171287, US Patent Publication 20110171176, and US Patent Publication 20110152353, US Patent Publication, 20110152346, US Patent Publication 20110160082, herein incorporated by reference. For example, including but not limited to the naturally occurring phosphodiester backbone of an oligonucleotide or polynucleotide can be partially or completely modified with phosphorothioate, phosphorodithioate, or methylphosphonate internucleotide linkage modifications, modified nucleoside bases or modified sugars can be used in oligonucleotide or polynucleotide synthesis, and oligonucleotides or polynucleotides can be labeled with a fluorescent moiety (for example, fluorescein or rhodamine) or other label (for example, biotin).

The polynucleotides can be single- or double-stranded RNA or single- or double-stranded DNA or double-stranded DNA/RNA hybrids or modified analogues thereof, and can be of oligonucleotide lengths or longer. In more specific embodiments the polynucleotides that provide single-stranded RNA in the plant cell are selected from the group consisting of (a) a single-stranded RNA molecule (ssRNA), (b) a single-stranded RNA molecule that self-hybridizes to form a double-stranded RNA molecule, (c) a double-stranded RNA molecule (dsRNA), (d) a single-stranded DNA molecule (ssDNA), (e) a single-stranded DNA molecule that self-hybridizes to form a double-stranded DNA molecule, and (f) a single-stranded DNA molecule including a modified Pol III gene that is transcribed to an RNA molecule, (g) a double-stranded DNA molecule (dsDNA), (h) a double-stranded DNA molecule including a modified Pol III gene that is transcribed to an RNA molecule, (i) a double-stranded, hybridized RNA/DNA molecule, or combinations thereof. In some embodiments these polynucleotides include chemically modified nucleotides or non-canonical nucleotides. In some embodiments, the oligonucleotides may be blunt-ended or may comprise a 3' overhang of from 1-5 nucleotides of at least one or both of the strands. Other configurations of the oligonucleotide are known in the field and are contemplated herein. In embodiments of the method the polynucleotides include double-stranded DNA formed by intramolecular hybridization, double-stranded DNA formed by intermolecular hybridization, double-stranded RNA formed by intramolecular hybridization, or double-stranded RNA formed by intermolecular hybridization. In one embodiment the polynucleotides include single-stranded DNA or single-stranded RNA that self-hybridizes to form a hairpin structure having an at least partially double-stranded structure including at least one segment that will hybridize to RNA transcribed from the gene targeted for suppression. Not intending to be bound by any mechanism, it is believed that such polynucleotides are or will produce single-stranded RNA with at least one segment that will hybridize to RNA transcribed from the gene targeted for suppression. In certain other embodiments the polynucleotides further includes a promoter, generally a promoter functional in a plant, for example, a pol II promoter, a pol III promoter, a pol IV promoter, or a pol V promoter.

The term "gene" refers to chromosomal DNA, plasmid DNA, cDNA, intron and exon DNA, artificial DNA polynucleotide, or other DNA that encodes a peptide, polypeptide, protein, or RNA transcript molecule, and the genetic elements flanking the coding sequence that are involved in the regulation of expression, such as, promoter regions, 5' leader regions, 3' untranslated regions. The gene or a fragment thereof is isolated and subjected to polynucleotide sequencing methods that determines the order of the nucleotides that comprise the gene. Any of the components of the gene are potential targets for the oligonucleotides and polynucleotides.

The polynucleotide molecules are designed to modulate expression by inducing regulation or suppression of an endogenous PDS gene in a plant and are designed to have a nucleotide sequence essentially identical or essentially complementary to the nucleotide sequence of an endogenous PDS gene of a plant or to the sequence of RNA transcribed from an endogenous PDS gene of a plant, including a transgene in a plant that provides for a herbicide resistant PDS enzyme, which can be coding sequence or non-coding sequence. Effective molecules that modulate expression are referred to as "a trigger molecule, or trigger polynucleotide". By "essentially identical" or "essentially complementary" is meant that the trigger polynucleotides (or at least one strand of a double-stranded polynucleotide or portion thereof, or a portion of a single strand polynucleotide) are designed to hybridize to the endogenous gene noncoding sequence or to RNA transcribed (known as messenger RNA or an RNA transcript) from the endogenous gene to effect regulation or suppression of expression of the endogenous gene. Trigger molecules are identified by "tiling" the gene targets with partially overlapping probes or non-overlapping probes of antisense or sense polynucleotides that are essentially identical or essentially complementary to the nucleotide sequence of an endogenous gene. Multiple target sequences can be aligned and sequence regions with homology in common are identified as potential trigger molecules for the multiple targets. Multiple trigger molecules of various lengths, for example 18-25 nucleotides, 26-50 nucleotides, 51-100 nucleotides, 101-200 nucleotides, 201-300 nucleotides or more can be pooled into a few treatments in order to investigate polynucleotide molecules that cover a portion of a gene sequence (for example, a portion of a coding versus a portion of a noncoding region, or a 5' versus a 3' portion of a gene) or an entire gene sequence including coding and noncoding regions of a target gene. Polynucleotide molecules of the pooled trigger molecules can be divided into smaller pools or single molecules inorder to identify trigger molecules that provide the desired effect.

The target gene RNA and DNA polynucleotide molecules (Table 1, SEQ ID NO: 1-78, and SEQ ID NO: 2138) are sequenced by any number of available methods and equipment. Some of the sequencing technologies are available commercially, such as the sequencing-by-hybridization platform from Affymetrix Inc. (Sunnyvale, Calif.) and the sequencing-by-synthesis platforms from 454 Life Sciences (Bradford, Conn.), Illumina/Solexa (Hayward, Calif.) and Helicos Biosciences (Cambridge, Mass.), and the sequencing-by-ligation platform from Applied Biosystems (Foster City, Calif.), as described below. In addition to the single molecule sequencing performed using sequencing-by-synthesis of Helicos Biosciences, other single molecule sequencing technologies are encompassed by the method of the invention and include the SMRT.™ technology of Pacific Biosciences, the Ion Torrent.™. technology, and nanopore sequencing being developed for example, by Oxford Nanopore Technologies. A PDS target gene comprising DNA or RNA can be isolated using primers or probes essentially complementary or essentially homologous to SEQ ID NO:1-78 and 2138 or a fragment thereof. A polymerase chain reaction (PCR) gene fragment can be produced using primers essentially complementary or essentially homologous to SEQ ID NO:1-78 and 2138 or a fragment thereof that is useful to isolate a PDS gene from a plant genome. SEQ ID NO: 1-78 and 2138 or fragments thereof can be used in various sequence capture technologies to isolate additional target gene sequences, for example, including but not limited to Roche NimbleGen® (Madison, Wis.) and Streptavdin-coupled Dynabeads® (Life Technologies, Grand Island, N.Y.) and US20110015084, herein incorporated by reference in its entirety.

Embodiments of functional single-stranded polynucleotides have sequence complementarity that need not be 100 percent, but is at least sufficient to permit hybridization to RNA transcribed from the target gene or DNA of the target gene to form a duplex to permit a gene silencing mechanism. Thus, in embodiments, a polynucleotide fragment is designed to be essentially identical to, or essentially complementary to, a sequence of 18 or more contiguous nucleotides in either the target PDS gene sequence or messenger RNA transcribed from the target gene. By "essentially identical" is meant having 100 percent sequence identity or at least about 83, 84, 85, 86, 87, 88, 89, 90, 91, 92, 93, 94, 95, 96, 97, 98, or 99 percent sequence identity when compared to the sequence of 18 or more contiguous nucleotides in either the target gene or RNA transcribed from the target gene; by "essentially complementary" is meant having 100 percent sequence complementarity or at least about 83, 84, 85, 86, 87, 88, 89, 90, 91, 92, 93, 94, 95, 96, 97, 98, or 99 percent sequence complementarity when compared to the sequence of 18 or more contiguous nucleotides in either the target gene or RNA transcribed from the target gene. In some embodiments polynucleotide molecules are designed to have 100 percent sequence identity with or complementarity to one allele or one family member of a given target gene (coding or non-coding sequence of a gene); in other embodiments the polynucleotide molecules are designed to have 100 percent sequence identity with or complementarity to multiple alleles or family members of a given target gene.

In certain embodiments, the polynucleotides used in the compositions that are essentially identical or essentially complementary to the target gene or transcript will comprise the predominant nucleic acid in the composition. Thus in certain embodiments, the polynucleotides that are essentially identical or essentially complementary to the target gene or transcript will comprise at least about 50%, 75%, 95%, 98% or 100% of the nucleic acids provided in the composition by either mass or molar concentration. However, in certain embodiments, the polynucleotides that are essentially identical or essentially complementary to the target gene or transcript can comprise at least about 1% to about 50%, about 10% to about 50%, about 20% to about 50%, or about 30% to about 50% of the nucleic acids provided in the composition by either mass or molar concentration. Also provided are compositions where the polynucleotides that are essentially identical or essentially complementary to the target gene or transcript can comprise at least about 1% to 100%, about 10% to 100%, about 20% to about 100%, about 30% to about 50%, or about 50% to a 100% of the nucleic acids provided in the composition by either mass or molar concentration.

"Identity" refers to the degree of similarity between two polynucleic acid or protein sequences. An alignment of the two sequences is performed by a suitable computer program. A widely used and accepted computer program for performing sequence alignments is CLUSTALW v1.6 (Thompson, et al. Nucl. Acids Res., 22: 4673-4680, 1994). The number of matching bases or amino acids is divided by the total number of bases or amino acids, and multiplied by 100 to obtain a percent identity. For example, if two 580 base pair sequences had 145 matched bases, they would be 25 percent identical. If the two compared sequences are of different lengths, the number of matches is divided by the shorter of the two lengths. For example, if there are 100 matched amino acids between a 200 and a 400 amino acid protein, they are 50 percent identical with respect to the shorter sequence. If the shorter sequence is less than 150 bases or 50 amino acids in length, the number of matches are divided by 150 (for nucleic acid bases) or 50 (for amino acids), and multiplied by 100 to obtain a percent identity.

Trigger molecules for specific gene family members can be identified from coding and/or non-coding sequences of gene families of a plant or multiple plants, by aligning and selecting 200-300 polynucleotide fragments from the least homologous regions amongst the aligned sequences and evaluated using topically applied polynucleotides (as sense or anti-sense ssDNA or ssRNA, dsRNA, or dsDNA) to determine their relative effectiveness in inducing the herbicidal phenotype. The effective segments are further subdivided into 50-60 polynucleotide fragments, prioritized by least homology, and reevaluated using topically applied polynucleotides. The effective 50-60 polynucleotide fragments are subdivided into 19-30 polynucleotide fragments, prioritized by least homology, and again evaluated for induction of the yield/quality phenotype. Once relative effectiveness is determined, the fragments are utilized singly, or again evaluated in combination with one or more other fragments to determine the trigger composition or mixture of trigger polynucleotides for providing the yield/quality phenotype.

Trigger molecules for broad activity can be identified from coding and/or non-coding sequences of gene families of a plant or multiple plants, by aligning and selecting 200-300 polynucleotide fragments from the most homologous regions amongst the aligned sequences and evaluated using topically applied polynucleotides (as sense or anti-sense ssDNA or ssRNA, dsRNA, or dsDNA) to determine their relative effectiveness in inducing the yield/quality phenotype. The effective segments are subdivided into 50-60 polynucleotide fragments, prioritized by most homology, and reevaluated using topically applied polynucleotides. The effective 50-60 polynucleotide fragments are subdivided into 19-30 polynucleotide fragments, prioritized by most homology, and again evaluated for induction of the yield/quality phenotype. Once relative effectiveness is determined, the fragments may be utilized singly, or in combination with one or more other fragments to determine the trigger composition or mixture of trigger polynucleotides for providing the yield/quality phenotype.

Methods of making polynucleotides are well known in the art. Chemical synthesis, in vivo synthesis and in vitro synthesis methods and compositions are known in the art and include various viral elements, microbial cells, modified polymerases, and modified nucleotides. Commercial preparation of oligonucleotides often provides two deoxyribonucleotides on the 3' end of the sense strand. Long polynucleotide molecules can be synthesized from commercially available kits, for example, kits from Applied Biosystems/Ambion (Austin, Tex.) have DNA ligated on the 5' end in a microbial expression cassette that includes a bacterial T7 polymerase promoter that makes RNA strands that can be assembled into a dsRNA and kits provided by various manufacturers that include T7 RiboMax Express (Promega, Madison, Wis.), AmpliScribe T7-Flash (Epicentre, Madison, Wis.), and TranscriptAid T7 High Yield (Fermentas, Glen Burnie, Md.). dsRNA molecules can be produced from microbial expression cassettes in bacterial cells (Ongvarrasopone et al. ScienceAsia 33:35-39; Yin, Appl. Microbiol. Biotechnol 84:323-333, 2009; Liu et al., BMC Biotechnology 10:85, 2010) that have regulated or deficient RNase III enzyme activity or the use of various viral vectors to produce sufficient quantities of dsRNA. PDS gene fragments are inserted into the microbial expression cassettes in a position in which the fragments are express to produce ssRNA or dsRNA useful in the methods described herein to regulate expression on a target PDS gene. Long polynucleotide molecules can also be assembled from multiple RNA or DNA fragments. In some embodiments design parameters such as Reynolds score (Reynolds et al. Nature Biotechnology 22, 326-330 (2004), Tuschl rules (Pei and Tuschl, Nature Methods 3(9): 670-676, 2006), i-score (Nucleic Acids Res 35: e123, 2007), i-Score Designer tool and associated algorithms (Nucleic Acids Res 32: 936-948, 2004. Biochem Biophys Res Commun 316: 1050-1058, 2004, Nucleic Acids Res 32: 893-901, 2004, Cell Cycle 3: 790-5, 2004, Nat Biotechnol 23: 995-1001, 2005, Nucleic Acids Res 35: e27, 2007, BMC Bioinformatics 7: 520, 2006, Nucleic Acids Res 35: e123, 2007, Nat Biotechnol 22: 326-330, 2004) are known in the art and may be used in selecting polynucleotide sequences effective in gene silencing. In some embodiments the sequence of a polynucleotide is screened against the genomic DNA of the intended plant to minimize unintentional silencing of other genes.

The trigger polynucleotide and oligonucleotide molecule compositions are useful in compositions, such as liquids that comprise the polynucleotide molecules at low concentrations, alone or in combination with other components, for example one or more herbicide molecules, either in the same solution or in separately applied liquids that also provide a transfer agent. While there is no upper limit on the concentrations and dosages of polynucleotide molecules that can useful, lower effective concentrations and dosages will generally be sought for efficiency. The concentrations can be adjusted in consideration of the volume of spray or treatment applied to plant leaves or other plant part surfaces, such as flower petals, stems, tubers, fruit, anthers, pollen, or seed. In one embodiment, a useful treatment for herbaceous plants using 25-mer oligonucleotide molecules is about 1 nanomole (nmol) of oligonucleotide molecules per plant, for example, from about 0.05 to 1 nmol per plant. Other embodiments for herbaceous plants include useful ranges of about 0.05 to about 100 nmol, or about 0.1 to about 20 nmol, or about 1 nmol to about 10 nmol of polynucleotides per plant. Very large plants, trees, or vines may require correspondingly larger amounts of polynucleotides. When using long dsRNA molecules that can be processed into multiple oligonucleotides, lower concentrations can be used. To illustrate embodiments, the factor 1×, when applied to oligonucleotide molecules is arbitrarily used to denote a treatment of 0.8 nmol of polynucleotide molecule per plant; 10×, 8 nmol of polynucleotide molecule per plant; and 100×, 80 nmol of polynucleotide molecule per plant.

The polynucleotide compositions are useful in compositions, such as liquids that comprise polynucleotide molecules, alone or in combination with other components either in the same liquid or in separately applied liquids that provide a transfer agent. As used herein, a transfer agent is an agent that, when combined with a polynucleotide in a composition that is topically applied to a target plant surface, enables the polynucleotide to enter a plant cell. In certain embodiments, a transfer agent is an agent that conditions the surface of plant tissue, e.g., leaves, stems, roots, flowers, or fruits, to permeation by the polynucleotide molecules into plant cells. The transfer of polynucleotides into plant cells can be facilitated by the prior or contemporaneous application of a polynucleotide-transferring agent to the plant tissue. In some embodiments the transferring agent is applied subsequent to the application of the polynucleotide composition. The polynucleotide transfer agent enables a pathway for polynucleotides through cuticle wax barriers, stomata and/or cell wall or membrane barriers into plant cells. Suitable transfer agents to facilitate transfer of the polynucleotide into a plant cell include agents that increase permeability of the exterior of the plant or that increase permeability of plant cells to oligonucleotides or polynucleotides. Such agents to facilitate transfer of the composition into a plant cell include a chemical agent, or a physical agent, or combinations thereof. Chemical agents for conditioning or transfer include (a) surfactants, (b) an organic solvent or an aqueous solution or aqueous mixtures of organic solvents, (c) oxidizing agents, (d) acids, (e) bases, (f) oils, (g) enzymes, or combinations thereof. Embodiments of the method can optionally include an incubation step, a neutralization step (e.g., to neutralize an acid, base, or oxidizing agent, or to inactivate an enzyme), a rinsing step, or combinations thereof. Embodiments of agents or treatments for conditioning of a plant to permeation by polynucleotides include emulsions, reverse emulsions, liposomes, and other micellar-like compositions. Embodiments of agents or treatments for conditioning of a plant to permeation by polynucleotides include counter-ions or other molecules that are known to associate with nucleic acid molecules, e.g., inorganic ammonium ions, alkyl ammonium ions, lithium ions, polyamines such as spermine, spermidine, or putrescine, and other cations. Organic solvents useful in conditioning a plant to permeation by polynucleotides include DMSO, DMF, pyridine, N-pyrrolidine, hexamethylphosphoramide, acetonitrile, dioxane, polypropylene glycol, other solvents miscible with water or that will dissolve phosphonucleotides in non-aqueous systems (such as is used in synthetic reactions). Naturally derived or synthetic oils with or without surfactants or emulsifiers can be used, e.g., plant-sourced oils, crop oils (such as those listed in the $9^{th}$ Compendium of Herbicide Adjuvants, publicly available on the worldwide web (internet) at herbicide-.adjuvants.com can be used, e.g., paraffinic oils, polyol fatty acid esters, or oils with short-chain molecules modified with amides or polyamines such as polyethyleneimine or N-pyrrolidine. Transfer agents include, but are not limited to, organosilicone preparations.

In certain embodiments, an organosilicone preparation that is commercially available as Silwet® L-77 surfactant having CAS Number 27306-78-1 and EPA Number: CAL. REG.NO. 5905-50073-AA, and currently available from Momentive Performance Materials, Albany, N.Y. can be used to prepare a polynucleotide composition. In certain embodiments where a Silwet L-77 organosilicone preparation is used as a pre-spray treatment of plant leaves or other plant surfaces, freshly made concentrations in the range of about 0.015 to about 2 percent by weight (wt percent) (e.g., about 0.01, 0.015, 0.02, 0.025, 0.03, 0.035, 0.04, 0.045, 0.05, 0.055, 0.06, 0.065, 0.07, 0.075, 0.08, 0.085, 0.09, 0.095, 0.1, 0.2, 0.3, 0.4, 0.5, 0.6, 0.7, 0.8, 0.9, 1.0, 1.1, 1.2, 1.3, 1.4, 1.5, 1.6, 1.7, 1.8, 1.9, 2.0, 2.1, 2.2, 2.3, 2.5 wt percent) are efficacious in preparing a leaf or other plant surface for transfer of polynucleotide molecules into plant cells from a topical application on the surface. In certain embodiments of the methods and compositions provided herein, a composition that comprises a polynucleotide molecule and an organosilicone preparation comprising Silwet L-77 in the range of about 0.015 to about 2 percent by weight (wt percent) (e.g., about 0.01, 0.015, 0.02, 0.025, 0.03, 0.035, 0.04, 0.045, 0.05, 0.055, 0.06, 0.065, 0.07, 0.075, 0.08, 0.085, 0.09, 0.095, 0.1, 0.2, 0.3, 0.4, 0.5, 0.6, 0.7, 0.8, 0.9, 1.0, 1.1, 1.2, 1.3, 1.4, 1.5, 1.6, 1.7, 1.8, 1.9, 2.0, 2.1, 2.2, 2.3, 2.5 wt percent) is used or provided.

In certain embodiments, any of the commercially available organosilicone preparations provided such as the following Breakthru S 321, Breakthru S 200 Cat #67674-67-3, Breakthru OE 441 Cat #68937-55-3, Breakthru S 278 Cat #27306-78-1, Breakthru S 243, Breakthru S 233 Cat #134180-76-0, available from manufacturer Evonik Goldschmidt (Germany), Silwet® HS 429, Silwet® HS 312, Silwet® HS 508, Silwet® HS 604 (Momentive Performance Materials, Albany, N.Y.) can be used as transfer agents in a polynucleotide composition. In certain embodiments where an organosilicone preparation is used as a pre-spray treatment of plant leaves or other surfaces, freshly made concentrations in the range of about 0.015 to about 2 percent by weight (wt percent) (e.g., about 0.01, 0.015, 0.02, 0.025, 0.03, 0.035, 0.04, 0.045, 0.05, 0.055, 0.06, 0.065, 0.07, 0.075, 0.08, 0.085, 0.09, 0.095, 0.1, 0.2, 0.3, 0.4, 0.5, 0.6, 0.7, 0.8, 0.9, 1.0, 1.1, 1.2, 1.3, 1.4, 1.5, 1.6, 1.7, 1.8, 1.9, 2.0, 2.1, 2.2, 2.3, 2.5 wt percent) are efficacious in preparing a leaf or other plant surface for transfer of polynucleotide molecules into plant cells from a topical application on the surface. In certain embodiments of the methods and compositions provided herein, a composition that comprises a polynucleotide molecule and an organosilicone preparation in the range of about 0.015 to about 2 percent by weight (wt percent) (e.g., about 0.01, 0.015, 0.02, 0.025, 0.03, 0.035, 0.04, 0.045, 0.05, 0.055, 0.06, 0.065, 0.07, 0.075, 0.08, 0.085, 0.09, 0.095, 0.1, 0.2, 0.3, 0.4, 0.5, 0.6, 0.7, 0.8, 0.9, 1.0, 1.1, 1.2, 1.3, 1.4, 1.5, 1.6, 1.7, 1.8, 1.9, 2.0, 2.1, 2.2, 2.3, 2.5 wt percent) is used or provided.

Organosilicone preparations used in the methods and compositions provided herein can comprise one or more effective organosilicone compounds. As used herein, the phrase "effective organosilicone compound" is used to describe any organosilicone compound that is found in an organosilicone preparation that enables a polynucleotide to enter a plant cell. In certain embodiments, an effective organosilicone compound can enable a polynucleotide to enter a plant cell in a manner permitting a polynucleotide mediated suppression of a target gene expression in the plant cell. In general, effective organosilicone compounds include, but are not limited to, compounds that can comprise: i) a trisiloxane head group that is covalently linked to, ii) an alkyl linker including, but not limited to, an n-propyl linker, that is covalently linked to, iii) a poly glycol chain, that is covalently linked to, iv) a terminal group. Trisiloxane head groups of such effective organosilicone compounds include, but are not limited to, heptamethyltrisiloxane. Alkyl linkers can include, but are not limited to, an n-propyl linker Poly glycol chains include, but are not limited to, polyethylene glycol or polypropylene glycol. Poly glycol chains can comprise a mixture that provides an average chain length "n" of about "7.5". In certain embodiments, the average chain length "n" can vary from about 5 to about 14. Terminal groups can include, but are not limited to, alkyl groups such as a methyl group. Effective organosilicone compounds are believed to include, but are not limited to, trisiloxane ethoxylate surfactants or polyalkylene oxide modified heptamethyl trisiloxane.

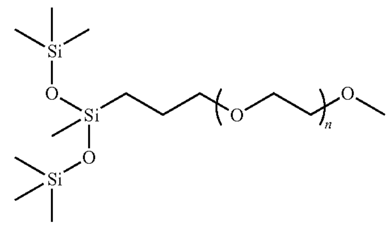

(Compound I: polyalkyleneoxide heptamethyltrisiloxane, average n = 7.5)

In certain embodiments, an organosilicone preparation that comprises an organosilicone compound comprising a trisiloxane head group is used in the methods and compositions provided herein. In certain embodiments, an organosilicone preparation that comprises an organosilicone compound comprising a heptamethyltrisiloxane head group is used in the methods and compositions provided herein. In certain embodiments, an organosilicone composition that comprises Compound I is used in the methods and compositions provided herein. In certain embodiments, an organosilicone composition that comprises Compound I is used in the methods and compositions provided herein. In certain embodiments of the methods and compositions provided herein, a composition that comprises a polynucleotide molecule and one or more effective organosilicone compound in the range of about 0.015 to about 2 percent by weight (wt percent) (e.g., about 0.01, 0.015, 0.02, 0.025, 0.03, 0.035, 0.04, 0.045, 0.05, 0.055, 0.06, 0.065, 0.07, 0.075, 0.08, 0.085, 0.09, 0.095, 0.1, 0.2, 0.3, 0.4, 0.5, 0.6, 0.7, 0.8, 0.9, 1.0, 1.1, 1.2, 1.3, 1.4, 1.5, 1.6, 1.7, 1.8, 1.9, 2.0, 2.1, 2.2, 2.3, 2.5 wt percent) is used or provided.

Compositions include but are not limited components that are one or more polynucleotides essentially identical to, or essentially complementary to a PDS gene sequence (promoter, intron, exon, 5' untranslated region, 3' untranslated region), a transfer agent that provides for the polynucleotide to enter a plant cell, a herbicide that complements the action of the polynucleotide, one or more additional herbicides that further enhance the herbicide activity of the composition or provide an additional mode of action different from the complementing herbicide, various salts and stabilizing agents that enhance the utility of the composition as an admixture of the components of the composition.

Methods include one or more applications of a polynucleotide composition and one or more applications of a permeability-enhancing agent for conditioning of a plant to permeation by polynucleotides. When the agent for conditioning to permeation is an organosilicone composition or compound contained therein, embodiments of the polynucleotide molecules are double-stranded RNA oligonucleotides, single-stranded RNA oligonucleotides, double-stranded RNA polynucleotides, single-stranded RNA polynucleotides, double-stranded DNA oligonucleotides, single-stranded DNA oligonucleotides, double-stranded DNA polynucleotides, single-stranded DNA polynucleotides, chemically modified RNA or DNA oligonucleotides or polynucleotides or mixtures thereof.

Compositions and methods are useful for modulating the expression of an endogenous PDS gene or transgenic PDS gene (for example, US Patent Publ. No. 20110098180) in a plant cell. In various embodiments, a PDS gene includes coding (protein-coding or translatable) sequence, non-coding (non-translatable) sequence, or both coding and non-coding sequence. Compositions can include polynucleotides and oligonucleotides designed to target multiple genes, or multiple segments of one or more genes. The target gene can include multiple consecutive segments of a target gene, multiple non-consecutive segments of a target gene, multiple alleles of a target gene, or multiple target genes from one or more species.

One aspect is a method for modulating expression of a PDS gene in a plant including (a) conditioning of a plant to permeation by polynucleotides and (b) treatment of the plant with the polynucleotide molecules, wherein the polynucleotide molecules include at least one segment of 18 or more contiguous nucleotides cloned from or otherwise identified from the target PDS gene in either anti-sense or sense orientation, whereby the polynucleotide molecules permeate the interior of the plant and induce modulation of the target gene. The conditioning and polynucleotide application can be performed separately or in a single step. When the conditioning and polynucleotide application are performed in separate steps, the conditioning can precede or can follow the polynucleotide application within minutes, hours, or days. In some embodiments more than one conditioning step or more than one polynucleotide molecule application can be performed on the same plant. In embodiments of the method, the segment can be cloned or identified from (a) coding (protein-encoding), (b) non-coding (promoter and other gene related molecules), or (c) both coding and non-coding parts of the target gene. Non-coding parts include DNA, such as promoter regions or the RNA transcribed by the DNA that provide RNA regulatory molecules, including but not limited to: introns, 5' or 3' untranslated regions, and microRNAs (miRNA), trans-acting siRNAs, natural anti-sense siRNAs, and other small RNAs with regulatory function or RNAs having structural or enzymatic function including but not limited to: ribozymes, ribosomal RNAs, t-RNAs, aptamers, and riboswitches.

All publications, patents and patent applications are herein incorporated by reference to the same extent as if each individual publication or patent application was specifically and individually indicated to be incorporated by reference.

The following examples are included to demonstrate examples of certain preferred embodiments. It should be appreciated by those of skill in the art that the techniques disclosed in the examples that follow represent approaches the inventors have found function well in the practice, and thus can be considered to constitute examples of preferred modes for its practice. However, those of skill in the art should, in light of the present disclosure, appreciate that many changes can be made in the specific embodiments that are disclosed and still obtain a like or similar result without departing from the spirit and scope.

EXAMPLES

Example 1. Polynucleotides Related to the PDS Gene Sequences

The target PDS polynucleotide molecule was isolated from the genome of *Abutilon theophrasti, Amaranthus chlorostachys, Amaranthus graecizans, Amaranthus palmeri, Amaranthus rudis, Amaranthus hybridus, Amaranthus lividus, Amaranthus spinosus, Amaranthus viridis, Ambrosia artemisiifolia, Ambrosia trifida, Commelina diffusa, Conyza candensis, Digitaria sanguinalis, Euphorbia heterophylla, Kochia scoparia, Lolium multiflorum.* and include molecules related to the expression of a polypeptide identified as a PDS, that include regulatory molecules, cDNAs comprising coding and noncoding regions of a PDS gene and fragments thereof as shown in Table 1.

Polynucleotide molecules were extracted from these plant species by methods standard in the field, for example, total RNA is extracted using Trizol Reagent (Invitrogen Corp, Carlsbad, Calif. Cat. No. 15596-018), following the manufacturer's protocol or modifications thereof by those skilled in the art of polynucleotide extraction that may enhance recover or purity of the extracted RNA. Briefly, start with 1 gram of ground plant tissue for extraction. Prealiquot 10 milliliters (mL) Trizol reagent to 15 mL conical tubes. Add ground powder to tubes and shake to homogenize. Incubate the homogenized samples for 5 minutes (min) at room temperature (RT) and then add 3 mL of chloroform. Shakes tubes vigorously by hand for 15-30 seconds (sec) and incubate at RT for 3 min. Centrifuge the tubes at 7,000 revolutions per minute (rpm) for 10 min at 4 degrees C. Transfer the aqueous phase to a new 1.5 mL tube and add 1 volume of cold isopropanol. Incubate the samples for 20-30 min at RT and centrifuge at 10,000 rpm for 10 min at 4 degrees C. Wash pellet with Sigma-grade 80 percent ethanol. Remove the supernatant and briefly air-dry the pellet. Dissolve the RNA pellet in approximately 200 microliters of DEPC treated water. Heat briefly at 65 degrees C. to dissolve pellet and vortex or pipet to resuspend RNA pellet. Adjust RNA concentraiton to 1-2 microgram/microliter.

DNA was extracted using EZNA SP Plant DNA Mini kit (Omega Biotek, Norcross Ga., Cat # D5511) and Lysing Matrix E tubes (Q-Biogen, Cat #6914), following the manufacturer's protocol or modifications thereof by those skilled in the art of polynucleotide extraction that may enhance recover or purity of the extracted DNA. Briefly, aliquot ground tissue to a Lysing Matrix E tube on dry ice, add 800 μl Buffer SP1 to each sample, homogenize in a bead beater for 35-45 sec, incubate on ice for 45-60 sec, centrifuge at ≥14000 rpm for 1 min at RT, add 10 microliter RNase A to the lysate, incubate at 65° C. for 10 min, centrifuge for 1 min at RT, add 280 μl Buffer SP2 and vortex to mix, incubate the samples on ice for 5 min, centrifuge at ≥10,000 g for 10 min at RT, transfer the supernatant to a homogenizer column in a 2 ml collection tube, centrifuge at 10,000 g for 2 min at RT, transfer the cleared lysate into a 1.5 ml microfuge tube, add 1.5 volumes Buffer SP3 to the cleared lysate, vortex immediately to obtain a homogeneous mixture, transfer up to 650 μl supernatant to the Hi-Bind column, centrifuge at 10,000 g for 1 min, repeat, apply 100 μl 65° C. Elution Buffer to the column, centrifuge at 10,000 g for 5 min at RT.

Next-generation DNA sequencers, such as the 454-FLX (Roche, Branford, Conn.), the SOLiD (Applied Biosystems,), and the Genome Analyzer (HiSeq2000, Illumina, San Diego, Calif.) were used to provide polynucleotide sequence from the DNA and RNA extracted from the plant tissues. Raw sequence data is assembled into contigs. The contig sequence is used to identify trigger molecules that can be applied to the plant to enable regulation of the gene expression.

The target DNA sequence isolated from genomic (gDNA) and coding DNA (cDNA) from the various weedy plant species for the PDS gene and the assembled contigs as set forth in SEQ ID NOs 1-78 and Table 1. The EPSPS gene was isolated from dandelion (*Taraxacum officinale*) and a PDS3 gene promoter fragment (SEQ ID NO: 2138) was used as a target for testing trigger molecules.

Example 2. Polynucleotides Related to the Trigger Molecules

The gene sequences and fragments of Table 1 were divided into 200 polynucleotide (200-mer) lengths with 25 polynucleotide overlapping regions (SEQ ID NO:79-2010). These polynucleotides are tested to select the most efficacious trigger regions across the length of any target sequence. The trigger polynucleotides are constructed as sense or anti-sense ssDNA or ssRNA, dsRNA, or dsDNA, or dsDNA/RNA hybrids and combined with an organosilicone based transfer agent to provide a polynucleotide preparation. The polynucleotides are combined into sets of two to three polynucleotides per set, using 4-8 nmol of each polynucleotide. Each polynucleotide set is prepared with the transfer agent and applied to a plant or a field of plants in combination with a PDS inhibitor containing herbicide, or followed by a PDS inhibitor treatment one to three days after the polynucleotide application, to determine the effect on the plant's susceptibility to a PDS inhibitor. The effect is measured as stunting the growth and/or killing of the plant and is measured 8-14 days after treatment with the polynucleotide set and PDS inhibitor. The most efficacious sets are identified and the individual polynucleotides are tested in the same methods as the sets are and the most efficacious single 200-mer identified. The 200-mer sequence is divided into smaller sequences of 50-70-mer regions with 10-15 polynucleotide overlapping regions and the polynucleotides tested individually. The most efficacious 50-70-mer is further divided into smaller sequences of 25-mer regions with a 12 to 13 polynucleotide overlapping region and tested for efficacy in combination with PDS inhibitor treatment. By this method it is possible to identify an oligonucleotide or several oligonucleotides that are the most efficacious trigger molecule to effect plant sensitivity to a PDS inhibitor or modulation of a PDS gene expression. The modulation of PDS gene expression is determined by the detection of PDS siRNA molecules specific to a PDS gene or by an observation of a reduction in the amount of PDS RNA transcript produced relative to an untreated plant or by merely observing the anticipated phenotype of the application of the trigger with the PDS inhibitor containing herbicide. Detection of siRNA can be accomplished, for example, using kits such as mirVana (Ambion, Austin Tex.) and mirPremier (Sigma-Aldrich, St Louis, Mo.).

The target DNA sequence isolated from genomic (gDNA) and coding DNA (cDNA) from the various weedy plant species for the PDS gene and the assembled contigs as set forth in SEQ ID NOs 1-78 were divided into polynucleotide fragments as set forth in SEQ ID NOs 79-2010.

The gene sequences and fragments of Table 1 were compared and 21-mers of contiguous polynucleotides were identified that had homology across the various PDS gene sequences. The purpose is to identify trigger molecules that are useful as herbicidal molecules or in combination with a PDS inhibitor herbicide across a broad range of weed species. The sequences SEQ ID NOs 2011-2136 represent the 21-mers that were present in the PDS gene of at least eight of the weed species of Table 1. It is contemplated that additional 21-mers can be selected from the sequences of Table 1 that are specific for a single weed species or a few weeds species within a genus or trigger molecules that are at least 18 contiguous nucleotides, at least 19 contiguous nucleotides, at least 20 contiguous nucleotides or at least 21 contiguous nucleotides in length and at least 85 percent identical to a PDS gene sequence selected from the group consisting of SEQ ID NO:1-78 or fragment thereof.

By this method it is possible to identify an oligonucleotide or several oligonucleotides that are the most efficacious trigger molecule to effect plant sensitivity to PDS inhibitor or modulation of PDS gene expression. The modulation of PDS gene expression is determined by the detection of PDS siRNA molecules specific to PDS gene or by an observation of a reduction in the amount of PDS RNA transcript produced relative to an untreated plant or by merely observing the anticipated phenotype of the application of the trigger with the PDS inhibitor containing herbicide. Detection of siRNA can be accomplished, for example, using kits such as mirVana (Ambion, Austin Tex.) and mirPremier (Sigma-Aldrich, St Louis, Mo.).

The target DNA sequence isolated from genomic (gDNA) and coding DNA (cDNA) from the various weedy plant species for the PDS gene and the assembled contigs as set forth in SEQ ID NOs 1-78 were divided into fragments as set forth in SEQ ID NOs 2011-2136.

Example 3. Methods Related to Treating Plants or Plant Parts with a Topical Mixture of the Trigger Molecules Glyphosate-sensitive Palmer amaranth (*A. palmeri* R-22) plants were grown in the greenhouse (30/20 C day/night T; 14 hour photoperiod) in 4 inch square pots containing Sun Gro® Redi-Earth and 3.5 kg/cubic meter Osmocote® 14-14-14 fertilizer. Palmer amaranth plants at 5 to 10 cm in height were pre-treated with a mixture of oligonucleotides one of which was a SEQ ID NO: 2137 at 0.8 nmol comprising at least one oligonucleotide targeting PDS coding or noncoding regions, formulated in 10 millimolar sodium phosphate buffer (pH 6.8) containing 2% ammonium sulfate and 0.5% Silwet L-77. Plants were treated manually by pipetting 10 μL of polynucleotide solution on four fully expanded mature leaves, for a total of 40 microliters of solution per plant. Twenty-four and forty-eight hours later, the plants were treated with norflurazon (Solicam®, Syngenta, Greensboro, N.C.) at 675 g ai/ha, crop oil concentrate (COC) at 1% is added to the herbicide treatments. Four replications of each treatment was conducted. Plant height is determined just before ssDNA treatment and at intervals upto twelve days after herbicide treatments to determine effect of the oligonucleotide and herbicide treatments. The norflurazon and oligonucleotide treatment resulted in more injury to the plants than the norflurazon alone, see FIG. 1.

Treatment of dandelion (*Taraxacum officinale*) and prickly lettuce (*Lactuca serriola*) with a pool of antisense ssDNA trigger polynucleotides resulted in a strong response by the treated plant to the trigger polynucleotides without the addition of a herbicide. The treatment was conducted in sequential steps, the first step was the plants were treated with 0.1 percent Silwet L-77 and then treatment with the ssDNA trigger oligonucleotide pools (pool 1 and pool 2) in 0.01 percent Silwet L-77 and 5 mM sodium phosphate buffer (pH6.8). Pool 1 (SEQ ID NO: 2139-2144) and Pool 2 (SEQ ID NO: 2145-2150) both provide a strong growth inhibition in the plants to treatment with the polynucleotide relative to the plant not treated (control) with the polynucleotide. The result is illustrated in FIG. 2, the image was taken 38 days after treatment.

In another treatment of dandelion, 5 pools of 4 or 5 dsDNA oligonucleotides (homologous and complementary to the dandelion PDS3 gene promoter, PDS3P) each were mixed in a liquid solution (formulation) of 1 percent Silwet L-77 plus 2 percent ammonium sulfate plus 20 mM sodium phosphate buffer at 10 nm per oligonucleotide in 10 microliters droplets applied to four leaves of a treated plant with four replications per pool. Trigger pool PDS3P 1-5 contains SEQ ID NO: 2153-2157, PDS3P 6-10 contains SEQ ID NO: 2158-2162, PDS3P 11-15 contains SEQ ID NO: 2163-2167, PDS3P 16-20 contains SEQ ID NO: 2168-2172, PDS3P 21-24 contains SEQ ID NO: 2173-2176. The growth of the treated and control (formulation treated) were rated 14 days after the treatment relative to the untreated control. The growth of the treated plants were substantially reduced (47-66 percent, visual rating) relative to the control (10 percent) treated with the formulation without the oligonucleotides as shown in Table 2. In another treatment of dandelion, two long polynucleotide trigger molecules, SEQ ID NO: 2151 and SEQ ID NO: 2152 demonstrated an average in 4 replications of 15-40 percent growth reduction by visual rating 14 days after treatment, however, there was more variability in the replications of this test compared to tests where the shorter oligonucleotide triggers were used.

TABLE 2

Dandelion treated with dsDNA oligonucleotides to PDS3 promoter target

| Trigger pools | trigger type | REP 1 | REP 2 | REP 3 | REP 4 | AVG |
|---|---|---|---|---|---|---|
| PDS3P 1-5 | dsDNA | 50 | 50 | 50 | 50 | 50 |
| PDS3P 6-10 | dsDNA | 55 | 65 | 60 | 50 | 57.5 |
| PDS3P 11-15 | dsDNA | 50 | 50 | 50 | 40 | 47.5 |
| PDS3P 16-20 | dsDNA | 75 | 60 | 60 | 50 | 61.25 |
| PDS3P 21-24 | dsDNA | 70 | 70 | 60 | 65 | 66.25 |
| Control | none | 10 | 10 | 10 | 10 | 10 |

Example 4. A Method to Control Weeds in a Field

A method to control weeds in a field comprises the use of trigger polynucleotides that can modulate the expression of a PDS gene in one or more target weed plant species. An analysis of PDS gene sequences from seventeen plant species provided a collection of 2'-mer polynucleotides that can be used in compositions to affect the growth or develop or sensitivity to PDS inhibitor herbicide to control multiple weed species in a field. A composition containing 1 or 2 or 3 or 4 or more of the polynucleotides of (SEQ ID NOs 2011-2136) would enable broad activity of the composition against the multiple weed species that occur in a field environment.

The method includes creating a composition that comprises components that include at least one polynucleotide of SEQ ID NOs 2011-2136 or any other effective gene expression modulating polynucleotide essentially identical or essentially complementary to SEQ ID NO:1-78 or fragment thereof, a transfer agent that mobilizes the polynucleotide into a plant cell and a PDS inhibiting herbicide and optionally a polynucleotide that modulates the expression of an essential gene and optionally a herbicide that has a different mode of action relative to a PDS inhibitor. The polynucleotide of the composition includes a dsRNA, ssDNA or dsDNA or a combination thereof. A composition containing a polynucleotide can have a use rate of about 1 to 30 grams or more per acre depending on the size of the polynucleotide and the number of polynucleotides in the composition. The composition may include one or more additional herbicides as needed to provide effective multi-species weed control. A field of crop plants in need of weed plant control is treated by spray application of the composition. The composition can be provided as a tank mix, a sequential treatment of components (generally the polynucleotide followed by the herbicide), a simultaneous treatment or mixing of one or more of the components of the composition from separate containers. Treatment of the field can occur as often as needed to provide weed control and the components of the composition can be adjusted to target specific weed species or weed families.

TABLE 1

Weed species and PDS gene sequences

| SEQ ID NO | SPECIES | TYPE | LENGTH | SEQ |
|---|---|---|---|---|
| 1 | Abutilon theophrasti | cDNA | 1915 | TTGAAGAAAATGAGTCTCTGTGGGAGTGTTTCTGC TGTGCACTTAAACTTCCAAAGCAACACGATAAGCAT GGGAAGTGTTTTAGCTTTTAGAAGCGGTGAATCCA TGGGAAATTCCTTGAGAATTCCCTTAAAAAAGAGG TCAAGTAAGGGTGCACGTCCTTTGCAGGTAGTTTG CATAGATTATCCAAGGCCAGAGCTTGAGAGTACTG CTAACTTTTTGGAGGCTGCTTCTCTATCTGCTTCTTT TCGTTCTGCTCCCCGTCCAACTAAGCCATTGAAAGT CATAATTGCTGGTGCAGGTTTGGGTGGTTTGTCAA CTGCTAAGTATCTGGCGGATGCAGGTCATAAACCA ATATTATTAGAAGCGAGAGATGTTCTAGGTGGAAA GGTGGCTGCATGGAAAGATGATGATGGAGATTGG TATGAGACAGGCTTACATATATTCTTTGGGGCTTAC CCAAATGTGCAAAACTTGTTTGGTGAACTTGGCATC AATGATCGGCTGCAATGGAAGGAGCATTCTATGAT ATTTGCGATGCCAAATAAACCTGGAGAGTTCAGTC GATTTGATTTTCCAGAAGTTCTACCTGCACCCTTAA ATGGGATATGGGCCATTTTGAAGAACAATGAAATG CTGACTTGGCCAGAGAAAGTGAAATTTGCAATAGG ACTGCTACCCGCAATTGTTGGTGGACAAGCTTATGT TGAGGCCCAAGATGGTTTATCTGTTAAAGAGTGGA TGAGAAAGCAGGGGGTACCTGATCGTGTGACCGA GGAGGTGTTTATTGCCATGTCAAAGGCTCTAAACTT CATTAACCCAGATGAACTTTCAATGCAATGTATATT GATTGCTTTGAATCGATTTCTTCAGGAGAAACATG GATCAAAGATGGCATTCTTGGATGGCAACCCTCCA GAGAGGCTTTGCATGCCAATCGTTAATCATATTGA GTCATTAGGTGGTGAGGTCCGGCTTAACTCACGAA TAAAGAAAATAGAGCTCAATGATGATGGAACTGTG AGTAGTTTTCTTTTAACTAATGGCAGTACAATTGAA GGAGATGCTTATGTAGTTGCAACTCCAGTTGATATC TTCAAGTTACTTTTGCCTGAAGACTGGAGAGCGATT |

TABLE 1-continued

Weed species and PDS gene sequences

| SEQ ID NO | SPECIES | TYPE | LENGTH | SEQ |
|---|---|---|---|---|
| | | | | TCTTACTTCAAGAAGTTAGAGAAATTAGTAGGAGT<br>TCCAGTTATCAATGTTCACATCTGGTTCGATAGGAA<br>ATTGAAGAACACCGCTGATAATCTTCTCTTCAGCAG<br>AAGTTCTCTTCTAAGTGTTTATGCCGACATGTCTGT<br>AACGTGTAAGGAATACTACAATCCAAACCAATCCA<br>TGTTGGAGTTGGTTTTTGCTCCGGCAGAAGAATGG<br>GTTGCACGTAGTGACTCAGAAATTATTGATGCTAC<br>AATGAAGGAACTTGCAAAGCTCTTTCCTGATGAAA<br>TATCTGCAGATCAGAGTAAAGCAAAAATCGTGAAG<br>TACCATGTCGTTAAAACACCAAGATCTGTATATAAA<br>ACTGTTCCGAATTGTGAACCCTGCCGCCCCTTGCAA<br>AGATCTCCGATACAAGGATTCTATCTAGCAGGTGA<br>TTACACAAAGCAAAGTATTTAGCTTCAATGGAAG<br>GTGCTGTCCTCTCAGGGAAGCTTTGTGCACAGTCTA<br>TTGTACAGGATTACGAGTTGCTTAGCTACTTTGGGA<br>CAAAGAAGGTTGACAGTGGCAAGCATCAACTGATG<br>TCGTTTAAATCGAGGTAAACAGTTCACAAGTTACC<br>GAGGATCATCTGCTAATCCATTGTTTAAGGCCACTT<br>AGATTAGAGGTCTTTTTTCATTACATATGTATACTG<br>AATACCCCATATAAAAACCTGAAACTTGTGCAAAG<br>ATAGCATCACAAACTGTGTGTAAAATTCTTTTGATG<br>GAATCTACATGATCTTCAATATCCCGTTAAAAGAAA<br>AAA |
| 2 | Amaranthus chlorostachys | cDNA | 414 | GATTCAGTTGGACCAGAGTGGAAGCGTGAAGAGT<br>TTTTTGCTAAATAACGGGAGGGAAATACGAGGAGA<br>TGCCTATGTTTTTGCCACCCCAGTTGACATCTTGAA<br>GCTGTTACTACCCGATACTTGGAAGGAAATCTCATA<br>CTTCAAAAAGCTTGAGAAATTAGTGGGCGTTCCTG<br>TGATTAATGTTCACATATGGTTTGACAGAAAATTAA<br>AGAATACATATGACCATCTACTCTTCAGCAGGAGTC<br>CTCTTTTGAGTGTCTACGCTGATATGTCGGAGACAT<br>GCAAGGAATATAAGGATCCTAATAGATCCATGCTG<br>GAGCTGGTTTTTGCACCCGCGGAGGAATGGATTTC<br>ACGAAGCGACACTGATATTATCGAGGCAACAATGA<br>AAGAGCTTGCCAAGCTTTTCCCGGG |
| 3 | Amaranthus graecizans | cDNA | 2020 | GAACAAACTTTGTGGGGGGGTGGTGAAAAATGAG<br>TCATTTTGGATATGCTTGTGCTACTCAATCCACATC<br>AAGATATGTTCTTTTAGGAAATTCAAATAACCCCAC<br>TTCAGTTTCATCTATTGGAAGTGATTTTTTGGGTCA<br>TTCTGTGAGAAATTTCAGTGTTAGTAAAGTTTATGG<br>TGGAAAGCAAAGAAATGGGCACTGCCCTTTAAAGG<br>TTGTTTGTATAGATTATCCTAGGCCAGAGCTTGAAA<br>GTACATCCAATTTCTTGGAAGCCGCCTACTTATCTT<br>CTACTTTTCGGAATTCGCCTCGTCCTCAGAAGCCAT<br>TAGAAGTTGTAATTGCCGGAGCAGGTTTGGCTGGT<br>CTATCCACGGCAAAGTATTTAGCTGATGCAGGTCA<br>CAAACCCATATTGCTGGAAGCACGAGATGTTTTAG<br>GAGGAAAGGTTGCAGCATGGAAGGATGAGGATGG<br>TGACTGGTATGAGACTGGGCTACATATATTCTTTGG<br>GGCATATCCAAATATCCAAAATCTATTTGGAGAACT<br>TGGTATAAATGACCGATTGCAATGGAAGGAGCACT<br>CTATGATTTTTGCAATGCCTAGCAAACCCGGTGAAT<br>TCAGTCGCTTTGATTTTCTCGAAGTCCTGCCTGCAC<br>CATTGAATGGCATATGGGCAATCCTAAGGAATAAT<br>GAAATGCTAACCTGGCCAGAAAAAATCAAGTTTGC<br>CATTGGCTTGTTGCCTGCTATGGCTGGCGGACAGT<br>CATATGTTGAGGCACAAGATGGTTTGAGTGTCCAA<br>GAGTGGATGAGAAAGCAAGGAGTACCCGATCGTG<br>TAACTGATGAAGTATTTATTGCCATGTCAAAGGCAC<br>TGAACTTCATAAATCCCGATGAACTTTCGATGCAGT<br>GCATCTTGATAGCTCTTAACCGATTCCTACAGGAGA<br>AACATGGTTCTAAGATGGCCTTTCTAGACGGAAAC<br>CCTCCAGAGAGGCTTTGCATGCCTATTGTTAAGCAC<br>ATTGAGTCACTAGGTGGTGAAGTTCAACTTAACTCT<br>CGTATACAAAAGATTGAGTTGGATCAGAGTGGAAG<br>CGTGAAGAGTTTTTTGCTAAATAACGGGAGGGAAA<br>TACGAGGAGATGCCTATGTTTTTGCCACCCCAGTTG<br>ACATCTTGAAGCTGTTACTACCTGATACTTGGAAGG<br>AAATCTCATACTTCAAAAAGCTTGAGAAATTAGTG<br>GGCGTTCCTGTGATTAATGTTCACATATGGTTTGAC<br>AGAAAATTAAAGAATACGTATGACCATCTACTCTTC<br>AGCAGGAGTCCTCTTTTGAGTGTCTATGCTGATATG<br>TCAGAGACATGCAAGGAGTATAAGGATCCAAATAG |

TABLE 1-continued

Weed species and PDS gene sequences

| SEQ ID NO | SPECIES | TYPE | LENGTH | SEQ |
|---|---|---|---|---|
| | | | | ATCCATGCTGGAACTTGTTTTTGCACCCGCGGAGG<br>AATGGATTTCACGAAGCGACACTGATATTATCGAG<br>GCAACAATGAATGAGCTTGCCAAGCTTTTCCCGGA<br>TGAAATCGCTGCTGACGGGAGCAAGGCCAAGATCC<br>TTAAATATCATGTCGTCAAAACTCCAAGGTCGGTTT<br>ATAAGACAGTACCGGATTGTGAGCCTTGTCGGCCG<br>CTGCAAAGATCACCAATAGAGGGATTCTATTTAGC<br>TGGTGATTACACAAAACAAAAATATTTGGCTTCTAT<br>GGAAGGTGCTGTCTTATCTGGGAAGCTTTGTGCAC<br>AGGCTATTGTACAGGATTATGATCTGCTGAGTTCTC<br>GAGCACAAAGAGAATTGGCGGCGAGAAGCAATGT<br>ATAACCCTGGATTGCTTCGACATCCGCCATTGATTT<br>TCATTCGAGATCAGGATTGGGAATCTGATCAGTCA<br>TCGAATAATGATCGGCTGTAAACAAAATTATGGGG<br>GTTGCATACCGGTGCTCGTCAAGTTGACGTATAAA<br>TTCTCCAGAATGAAGATTTATTTGTAATGATATCTA<br>TTAAATATTTTAATTTATTTTCTGATAGAAATATGTA<br>TAGCTCACTTCTAGGGAATAAACATGTATGTGGAC<br>CAGTTAACTTGATTGAAATGTAAGTATCAACTTTGT |
| 4 | Amaranthus hybridus | cDNA | 1938 | CTAAATTCCAACAATTTGGTCCATTTTTCTTGTTCTT<br>TCAGTTTCACATACCCTCTTATCAATCTATATCCAAA<br>ACTATTTCATTTTCCAAACTCTTTTAAACCCAAAAAT<br>CAAAACTTTTGATTGAAGAACAAACTTTGGGGTTTT<br>GGAAAATGAGTCATTTTGGATATGCTTGTGCTACTC<br>AATCCACATCAAGATATGTTCTTTTAGGAAATTCAA<br>ATAACCACACTTCAATTTCATCTATTGGAAGTGATT<br>TTTTGGGTCATTCTGTGAGAAATTTCAGTTTTAGTA<br>AAGTTTATGGGGAAAGCAAAGAAATGGGCACTG<br>CCCTTTAAAGGTTGTTTGTATGGATTATCCTAGGCC<br>TGAGCTTGAAAGTACATCCAATTTCTTGGAAGCTGC<br>CTACTTATCTTCTACTTTTCGGAATTCGCCTCGTCCT<br>CAGAAGCCATTAGAAGTTGTAATTGCTGGAGCAGG<br>TTTGGCTGGTCTATCCACGGCAAAGTATTTAGCTGA<br>TGCAGGTCACAAACCCATATTGCTGGAAGCACGAG<br>ATGTTTTAGGAGGAAAGGTTGCAGCGTGGAAGGA<br>TGAGGATGGTGACTGGTACGAGACTGGGCTACAT<br>ATATTCTTTGGGGCTTATCCAAATATCCAAATCTA<br>TTTTGGAGAACTTGGTATAAATGATCGATTGCAATG<br>GAAGGAGCACTCTATGATTTTTGCAATGCCTAGCA<br>AGCCTGGTGAATTCAGTCGCTTTGATTTTCCCGAAG<br>TCCTGCCTGCACCATTAAATGGCATATGGGCAATCC<br>TAAGGAATAATGAAATGCTAACCTGGCCAGAAAAA<br>ATCAAGTTTGCCATTGGCTTGTTGCCTGCTATGGCT<br>GGCGGACAGTCATATGTTGAAGCACAAGACGGTTT<br>GAGTGTCCAAGAGTGGATGAGAAAACAAGGAGTA<br>CCCGATCGTGTAACTGATGAAGTATTTATTGCCATG<br>TCAAAGGCACTGAACTTCATAAATCCCGATGAACTT<br>TCAATGCAGTGCATCTTGATTGCTCTGAACCGATTC<br>CTGCAGGAGAAACATGGTTCTAAGATGGCCTTCCT<br>AGACGGAAACCCTCCAGAGAGGCTGTGCATGCCTA<br>TTGTTAAGCACATTGAGTCACTAGGTGGTGAAGTT<br>AAACTTAACTCTCGTATACAAAAGATTCAGTTGGAT<br>CAGAGTGGAAGCGTGAAGAGTTTTTTGCTAAATAA<br>CGGGAGGGAAATACGAGGAGATGCCTATGTTTTTG<br>CCACCCCAGTTGACATCTTGAAGCTGTTACTACCCG<br>ATACTTGGAAGGAAATCTCATACTTCAAAAAGCTTG<br>AAAAATTAGTGGGCGTTCCTGTGATTAATGTTCACA<br>TATGGTTTGACAGAAAATTAAAGAATACATATGAC<br>CATTTACTCTTCAGCAGAAGTCCTCTTTTGAGTGTCT<br>ATGCTGATATGTCGGAGACATGCAAGGAATATAAG<br>GATCCTAATAGATCCATGCTGGAACTGGTTTTTGCA<br>CCCGCGGAGGAATGGATTTCACGTAGCGACACTGA<br>TATTATAGAGGCAACAATGAAAGAGCTTGCCAAGC<br>TTTTCCCCGATGAAATTGCTGCCGATGGGAGCAAG<br>GCCAAGATCCTCAAATATCATGTCGTCAAAACTCCA<br>AGGTCGGTTTATAAGACTGTACCGGATTGTGAACC<br>TTGTCGGCCGCTGCAAAGATCACCAATAGAGGGTT<br>CTATTTAGCTGGTGATTACACAAAACAAAAATATT<br>TGGCTTCTATGGAAGGTGCTGTCTTATCTGGGAAG<br>CTTTGTGCTCAGGCTATTGTACAGGATTATGATCTG<br>CTGAGTTCTCGAGCACAAAGAGAATTGGCGGCGAC<br>AAGCAATGTATAAACCTGGATTGCTTTGACATCCGC<br>CATTGATTTTCATTCGAGATCTGGATTGGGAATCTG<br>ATCAGTCATCGAAAAAT |

TABLE 1-continued

Weed species and PDS gene sequences

| SEQ ID NO | SPECIES | TYPE | LENGTH | SEQ |
|---|---|---|---|---|
| 5 | Amaranthus lividus | cDNA | 1947 | GGGTTTTGGAAAATGAGTCATTTTGGATATGCTTGT GCTACTCAATCCACATCAAGATATGTTCTTTTGGGA AATTCAAATAACCCCACTTCAATTTCATCTATTGGA AGTGATTTTTTGGGTCATTCTGTGAGAAATTTCAGT GTTAGTAAAGTTTATGGGCAAAGCAAAGAAATG GGCACTGCCCTTTAAAGGTTGTTTGTATAGATTATC CTAGGCCTGAGCTTGAAAGTACATCCAATTTCTTGG AAGCCGCCTACTTATCTTCTACTTTTCGGAATTCGCC TCGTCCTCAGAAGCCATTAGAAGTTGTAATTGCCG GAGCAGGTTTGGCTGGTCTATCCACAGCAAAGTAT TTAGCTGATGCAGGTCACAAACCCATATTGTTGGA AGCACGAGATGTTTTAGGAGGAAAGGTTGCAGCG TGGAAGGATGAGGATGGTGACTGGTATGAGACTG GGCTACATATATTCTTTGGGGCATATCCAAATATCC AAAATCTATTTGGAGAACTTGGTATAAATGACCGA CTGCAATGGAAGGAGCACTCTATGATTTTTGCAAT GCCTAGCAAGCCCGGTGAATTCAGTCGCTTTGATTT TCCAGAAATCCTGCCTGCACCATTAAATGGCATATG GGCAATCCTAAGGAATAATGAAATGCTAACCTGGC CAGAAAAAATCAAGTTTGCCATTGGCTTGTTGCCTG CTATGGCGGGCGGACAGTCATATGTTGAAGCACAA GATGGTTTGAGTGTTCAAGAGTGGATGAGAAAAC AAGGAGTACCTGATCGTGTAACTGATGAAGTGTTT ATTGCCATGTCAAAGGCACTGAACTTCATAAATCCC GATGAACTTTCAATGCAGTGCATCTTGATTGCTCTG AACCGATTCCTGCAGGAGAAACATGGTTCTAAGAT GGCCTTCCTAGACGGAAACCCTCCAGAGAGGCTGT GCATGCCTATTGTTAAGCACATCGAGTCACTAGGT GGTGAAGTTAAACTTAACTCTCGGATACAAAAGAT TCAGTTGGACCAGAGTGGAAGCGTGAAGAGTTTTT GCTAAATAACGGGAGGGAAATACGAGGAGATGCC TATGTTTTGCCACCCCAGTTGACATCTTGAAGCTGT TACTACCCGATACTTGGAAGGAAATCTCATACTTCA AAAAGCTTGAGAAATTAGTGGGCGTTCCTGTGATT AATGTTCACATATGGTTTGACAGAAAATTAAAGAA TACATATGACCATCTACTCTTCAGCAGGAGTCCTCT TTTGAGTGTCTACGCTGATATGTCGGAGACATGCA AGGAATATAAGGATCCTAATAGATCCATGCTGGAA CTGGTTTTTGCACCCGCGGAGGAATGGATTTCACG AAGCGACACTGATATTATCGAGGCAACAATGAAAG AGCTTGCCAAGCTTTTCCCGGATGAAATCGCTGCC GATGGAAGCAAGGCCAAGATCCTTAAGTATCATGT TGTGAAAACACCAAGGTCGGTTTATAAGACTGTAC CGGATTGTGAACCTTGTCGGCCGCTGCAAAGATCA CCAATAGAGGGTTTCTATTTAGCTGGTGATTACACA AAACAAAATATTTGGCTTCTATGGAAGGTGCTGTCT TATCTGGGAAGCTTTGTGCACAGGCTATCGTACAG GATTATGATCTGCTGAGTTCTCGAGCACAAAGAGA ATTGGCGGCGACAAGCAATGTATAACCCTAAATTG CTTCGACATCCGCCATCGACTTTCATTCGAGATCTG GATTGGGAATCTGATCATCGAATAATGATCAGCTG TAAAGAAAATTGTGGGGGTTGCATACTGGTGCTGT TCAAGTTCTTGATGTACAAATTCTCCTGAAAGAAGA TTTATTTGTAATGATATATCAATTGATAGAAATATA TATAGCTTACTTCTAGGGAATTATGTATATGCACCA TTTA |
| 6 | Amaranthus palmeri | cDNA | 2117 | CCCTCTTATCAATCTATATCCAAAACTATTTCATTTT CCAAACTTTTTAAACCCAAAAATCAAAACTTTTGA TTGAAGAACAAACTTTGGGGGTTTTGGAAAATGAG TCATTTTGGATATGCTTGTGCTACTCAATCCACATC AAGATATGTTCTTTTAGGAAATTCAAATAACCCCAC TTCAATTTCATCTATTGGAAGTGATTTTTTGGGTCAT TCTGTGAGAAATTTCAGTGTTAGTAAAGTTTATGG GGAAAGCAAAGAAATGGGCATTGCCCTTTAAAGGT TGTTTGTATAGATTATCCTAGGCCAGAGCTTGAAA GTACATCCAATTTCTTGGAAGCCGCCTACTTATCTT CTACTTTTCGGAATTCGCCTCGTCCTCAGAAGCCAT TAGAAGTTGTAATTGCTGGAGCAGGTTTGGCTGGT TTATCCACGGCAAAGTATTTAGCTGATGCAGGTCA CAAACCCATATTGTTGGAAGCACGAGATGTTTTAG GAGGAAAGGTTGCAGCGTGGAAGGATGAGGATG GTGACTGGTATGAGACTGGGCTACATATATTCTTTG GGGCATATCCAAATGTCCAAAATCTATTTGGAGAA |

TABLE 1-continued

Weed species and PDS gene sequences

| SEQ ID NO | SPECIES | TYPE | LENGTH | SEQ |
|---|---|---|---|---|
| | | | | CTTGGTATAAATGACCGACTGCAATGGAAGGAGCA CTCTATGATTTTTGCAATGCCAGCAAGCCCGGTGAA TTCAGTCGCTTTGATTTTCCCGAAATCCTGCCTGCA CCATTAAATGGCATATGGGCAATCCTAAGGAATAA TGAAATGCTAACCTGGCCAGAAAAAATCAAGTTTG CCATTGGCTTGTTGCCTGCTATGGCGGGCGGACAG TCATATGTTGAAGCACAAGATGGTTTGAGTGTCCA AGAGTGGATGAGAAAACAAGGAGTACCCGATCGT GTAACTGATGAAGTGTTTATTGCCATGTCAAAGGC ACTGAACTTCATAAATCCCGATGAACTTTCAATGCA GTGCATCTTGATTGCTCTGAACCGATTCCTGCAGGA GAAACATGGTTCTAAGATGGCCTTCCTAGACGGAA ACCCTCCAGAGAGGCTGTGCATGCCTATTGTTAAG CACATCGAGTCACTAGGTGGTGAAGTTAAACTTAA CTCTCGTATACAAAAGATTCAGTTGGACCAGAGTG GAAGCGTGAAGAGTTTTTTGCTAAATAACGGGAGG GAAATACGAGGAGATGCCTATGTTTTTGCCACCCC AGTTGACATCTTGAAGCTGTTACTACCCGATACTTG GAAGGAAATCTCATACTTCAAAAAGCTTGAGAAAT TAGTGGGCGTTCCTGTGATTAATGTTCACATATGGT TTGACAGAAAATTAAAGAATACATATGACCATCTAC TCTTCAGCAGGAGTCCTCTTTTGAGTGTCTATGCTG ATATGTCGGAGACATGCAAGGAATATAAGGATCCA AATAGATCCATGCTGGAACTGGTTTTTGCACCCGC GGAGGAATGGATTTCACGAAGCGACACTGATATTA TGAGGCAACAATGAAAGAGCTTGCCAAGCTTTTCC CGGATGAAATCGCTGCCGATGGAAGCAAGGCCAA GATCCTCAAATATCATGTCGTCAAAACTCCAAGGTC GGTTTATAAGACTGTACCGGATTGTGAACCTTGTC GGCCGCTGCAAAGATCACCAATAGAGGGTTTCTAT TTAGCTGGTGATTACACAAAACAAAAATATTTGGCT TCTATGGAAGGTGCTGTCTTATCTGGGAAGCTTTGT GCACAGGCTATCGTACAGGATTATGATCTGCTGAG TTCTCGAGCACAAAGAGAATTGGCGGCGACAAGCA ATGTATAACCCTAAATTGCTTCGACATCCGCCATCG ATTTTCATTCGAGATTTGGATTGGGAATCTAATCAT CGAATAATGATTAGATGTAAACAAAATTATGGGGG TTGCATACTGGTGTTCTTCAAGTTCTTGATGTATAA ATTCTCCAGAAAGAAGATTTATTTGTAATGATATAT CAATTGATAGAAATATGTATAGCTTACTTCTAGGGA ATTATGTATGTGCACCATTTGTAACTTGATTGAAAT GTAAGTATCAACTTGGTCTCTTGATTGAAATGTAAG TATCAACATCTGTCTCTTATACACATCT |
| 7 | Amaranthus palmeri | Genomic | 14098 | TTGTGACATTTTTCCACACAACATGTGATACCTCCA GATTTAGCTTGAAAAGANNTTGATAGACTACTCAT ATCAACAAGGTGCATCTTCTTTTCATGAGAGCCCAT TTGCTAAGAATTCCACAGTTAAGCGTGCTTCATGGA GAGCAATCTTAGGATGAGTGACCTTCGAGGAAGTT TTCCTGGGTGCGCACGGGTGAGGCCAAAGTGCGTT AAAAAGACTTGTGTTGGTCTGTGGGGCTTGTCTAC AGTCTCCATGAGTAGTCACCGGCGGTACGAGAGGC CGGGGTGTTACATAAACAGACTCAAAGGCGCTAAG CCAAGTAGCCAATAGCAACATGTGTGGCCTGCGGA CAGTCACAAAAACACACAATTTCTTATTTTTACTCTC TTTTATCTCTTTTAGGCTTTAGCCATCAACAATAAAA CAACATGATAAAGCAATTCATTTACTGCTAAATTCC AACAATTTGGTCCCTTTTTCCTGTTCTTTCAGTTTCA CATACCCTCTTATCAATCTATATCCAAAACTATTTCA TTTTCCAAACTCTTTTAAACCCAAAAATCAAAACTTT TGATTGAAGAACAAACTTTGGGGGTTTTGGAAAAT GAGTCATTTTGGATATGCTTGTGCTACTCAATCCAC ATCAAGATATGTTCTTTTAGGAAATTCAAATAACCC CACTTCAATTTCATCTATTGGAAGTGATTTTTTGGG TCATTCTGTGAGAAATTTCAGTGTTAGTAAAGTTTA TGGAGGAAAGCAAAGAAATGGGCATTGCCCTTTAA AGGTTTTCTGCCTTTTTTTTTTTTTGATGATTTGATT TTCTGGGTAGGGATAAATGATAAAGATTGATTCAT TTTTTTTTAAATGAATAATTTGTTTTTTTGTATGATGC AGGTTGTTTGTATAGATTATCCTAGGCCAGAGCTTG AAAGTACATCCAATTTCTTGGAAGCCGCCTACTTAT CTTCTACTTTTCGGAATTCGCCTCGTCCTCAGAAGC CATTAGAAGTTGTAATTGCTGGAGCAGGTGAGTGG AAGGGTTCTTTACCTATTCTGTTGATTAGGGTCTTG TTGTGTTGCTTTTTGCTTTGCCAAATTGGATGCTGTT |

TABLE 1-continued

Weed species and PDS gene sequences

| SEQ ID NO | SPECIES | TYPE | LENGTH | SEQ |
|---|---|---|---|---|
| | | | | CTTGATTTTCTGGAGCTTTGGGCAAAATAGAAGCA |
| | | | | AAATTGAAAGCTAATTGAGTCAATTGAGATGTTTTT |
| | | | | GAGAAATCATTTATTGGCCGTTACTGTTTATTAGAG |
| | | | | AAAAAATATGGGTCAAGAAACGAAAAGATAATGG |
| | | | | AAAAACTACTTATAGGTGTCTTTTTTGATCATGAAT |
| | | | | CATGATGGATATATATGGTGTCAACTATCAAGACT |
| | | | | GCCATATAACTAATGTAGTATGCTTCCTTAAGGGGT |
| | | | | GGTGAAGAATAGACGTGTGGATGAGAAAATTGCT |
| | | | | GGGAATTTCCTATGCTTATGTAGAATGAGCTTCCTC |
| | | | | TTGTTGACATTAGTGAAAAGTGAAAAATTGGTGTA |
| | | | | TGAGTTTGCTTGATCGCTTTTGTGAGTGCTTCATTG |
| | | | | TCCGTTCCACACCTAGGTTATGTTGTAGGGTTGCAA |
| | | | | TATGTTAAATTGTTAGTGACGGCTGTCGTATAACAT |
| | | | | TATTGTATCTTATGCCATGGGCCAAATTTACCCCTA |
| | | | | TTCAACGACGCCATGCAGACCTAGGTGTAGTGAAA |
| | | | | AGTATGCAAGGGTTAATTGGACATCAAGCATGGCG |
| | | | | CCATGTTGTTTGAGTGTGGCAAAAAGACTTTACGCT |
| | | | | ACACCTCTAGACCAGTTAAGTATGTAAAGGGTGTT |
| | | | | GGGTCACCGCTCTAAAGTGGTGTGTCACATTTTATC |
| | | | | GAATTCGAGGATAAGCTGATCGTGGTATCAAGTGA |
| | | | | GAAAGAACGCAATATAGTGGAATTAGAAAGTTAA |
| | | | | GTAATAAGAAAAAGAAAAAAATGATATCTAGCTT |
| | | | | TAGGAAAATCTATCAGTGAGGAGAATATTGCAAAA |
| | | | | TACGTGGAAATTAAAACCAAGACAAAGCTAGCGAT |
| | | | | ATATGAGACAAAGTTAAAAATGTACAAAGAAATAT |
| | | | | ACGATAAGTTGACTCGAAAGAAGAGGATAACGATC |
| | | | | TTTATAGGATAGCCTAAAGGAGACAAATGATTATA |
| | | | | AACGATACTAGTTGAATGAACTATGAAGAGTGTCT |
| | | | | TAACCAAGCAAATATTGTTTAGAAATAAATTCAAAA |
| | | | | CTTTTTAATTCTTCAAATATGAACATGAGAACTGAC |
| | | | | TTCTCATTCTTTATTTTACTTCAAGGTTTGGCTGGTC |
| | | | | TATCCACGGCAAAGTATTTAGCTGATGCAGGTCAC |
| | | | | AAACCCATATTGTTGGAAGCACGAGATGTTTTAGG |
| | | | | AGGAAAGGTGTGTGCTATACGTTTCTCGTAGCTTAT |
| | | | | GAAACAAATTCATCGTGCTTATTCTCTTATTAGTTTA |
| | | | | TTTCAGACTATCAGATCATTTTTGAACTTTTTCCTCC |
| | | | | CTCTGTTCGGCTGTATTATTATATATGTGCAGCATG |
| | | | | ATTAAAAAATGGGTGCATTAACATATATGAAGTTTT |
| | | | | TTTTTTTTATCAAGGCGAGATTTTGTCATCCAAAAA |
| | | | | CTTTACTTCTGAACGTGCTGTATGATCCTGTTTCTGT |
| | | | | ATCTTCATTTGCTGGGATTTTCTCGAGGTTCCTGAC |
| | | | | TGCTTTCAGTTATTGTAGTTACCCATCCTGCATAAAT |
| | | | | TTGAGTTTACAGTTATTGTAATGAAAATAAATCGGC |
| | | | | TAATTATATCCTCGTCACAGTATGATGAATCTTGGG |
| | | | | CTAGTAAGAAAATGAGGTAGGAGGAATAATTATG |
| | | | | GTTAGTTTGATAATATGTGCCAAGAGAAATATTGT |
| | | | | AGTGTAAAGTTTCATTGTATTTCTTCCCGTGCTTATA |
| | | | | ATTTTTGCTCCACAGGTTGCAGCGTGGAAGGATGA |
| | | | | GGATGGTGACTGGTATGAGACTGGGCTACATATAT |
| | | | | TCTGTGAGTGATCTTCTAATTTTCTGCTTAATTGGCC |
| | | | | AGTTACCCATGTTCTTACAATGCGCTCTCTAGTCGT |
| | | | | GTTTATTGGAAAATCGATGTACTGAACATCTTCATA |
| | | | | TTTTCTTGAAGTTGGGGCATATCCAAATATCCAAAA |
| | | | | TCTATTTGGAGAACTTGGTATAAATGACCGACTGC |
| | | | | AATGGAAGGAGCACTCTATGATTTTTGCAATGCCT |
| | | | | AGCAAGCCCGGTGAATTCAGTCGCTTTGATTTTCCC |
| | | | | GAAATCCTGCCTGCACCATTAAATGGTTAGTATATC |
| | | | | GGTGATAACTGCCAAATTACTTGATGCAATGCAGT |
| | | | | ACCTTGTTAAGTACTTTGGATGTGACTCCACCTATA |
| | | | | ATACTTGCTATAATCTTCAATTTATTTCTCTTTCCTAC |
| | | | | ATTAGAAACTATAAGTATCCCGCTAAAGGACATGA |
| | | | | CCCCACTTACAAAGTTACAATACCCCATTAAAATAC |
| | | | | CCACTCACCCACTTTTTTTAATCGGTGTACCATCCGC |
| | | | | CCGAGGAGCAATCTCGAGGGGACAGCAGAGTACT |
| | | | | ACTTTAGTGTTATTGTGATGAAATAGGTACCTGCAT |
| | | | | CATATCTCATGTCCTGTGGATACCCATAAATGAACG |
| | | | | AAAAATTTCATTTTTATACGTATTATCCTGCTTTAGA |
| | | | | AGCTTGGAATATCATTGAACTTTTTTAATGTCCCAA |
| | | | | CATGAAAACAATCTGCATCTTGGTCTGTTTGCTACT |
| | | | | CCTAAATCCTAATGAGTCGGGCTGATTTATGTCTTT |
| | | | | GATGCTTTTGATCGTGTTTCGCAGGCATATGGGCA |
| | | | | ATCCTAAGGAATAATGAAATGCTAACCTGGCCAGA |
| | | | | AAAAATCAAGTTTGCCATTGGCTTGTTGCCTGCTAT |
| | | | | GGCAGGCGGACAGTCATATGTTGAAGCACAAGAT |
| | | | | GGTTTGAGTGTCCAAGAGTGGATGAGAAAACAAG |

TABLE 1-continued

Weed species and PDS gene sequences

| SEQ ID NO | SPECIES | TYPE | LENGTH | SEQ |
|---|---|---|---|---|
| | | | | TAGGAGCAGACTTTCGTTTCAGATTTTCCTCATTTT |
| | | | | GTTAATGGTTCTAGACTTCTAGCTGTAAACTTTGAC |
| | | | | TTTGTTGGGACGTCAATGCTGAAATTTTGTTTGTGC |
| | | | | ATTAATGCAGGGAGTACCCGATCGTGTAACTGATG |
| | | | | ATGTGTTTATTGCCATGTCAAAGGCACTGAACTTCA |
| | | | | TAAATCCTGATGAACTTTCAATGCAGTGCATCTTGA |
| | | | | TTGCTCTGAACCGATTCCTGCAGGCATGACTGCCTT |
| | | | | TCATTTTCTGCTTTAAATTTTTGGTTTTGTACGATAC |
| | | | | TTCTTAGTGCTTGTTTTTGCGACTATTCTCGAGTAAA |
| | | | | TAGGGGATATAAAATGACCGTGCTGTTTTTCATAA |
| | | | | ACTGACCTTGGGTAATGTATATCAACAGGAGAAAC |
| | | | | ATGGTTCTAAGATGGCCTTCCTAGACGGAAACCCT |
| | | | | CCAGAGAGGCTGTGCATGCCTATTGTTAAGCACAT |
| | | | | CGAGTCACTAGGTGGTGAAGTTAAACTAAATTCTC |
| | | | | GTATACAAAAGATTCAGTTGGACCAGAGTGGAAGC |
| | | | | GTGAAGAGTTTTTTGCTAAATAACGGGAGGGAAAT |
| | | | | ACGAGGAGATGCCTATGTTTTTGCCACCCCAGGTTT |
| | | | | TCTTCTCTCCCTTTTTTTACCATTAGTTCTCTATCAGA |
| | | | | CTCCGTAAAAGCTAGAGTAAAGAAAATGAAGATTC |
| | | | | TATTACAGAAATGGACACACTGTAAAGCTTAATTA |
| | | | | GTTTTGATCTTGGGCAAAGCATTTGTGTTTCCAAAT |
| | | | | TTGTTAATGGTTATTATTTAAATAGAACACTTATGTT |
| | | | | TGTGATGGGTAACAAACTAACAATAGGTCAAGCGT |
| | | | | TGAGCCAAAGTGTTATAACAATGATTATATAGTGT |
| | | | | ATATCATAGTGTAAAATTGCGGTAAATTGTGGTAA |
| | | | | TGGACGCAATCACAGTGTCGGGAGTGATTCGGTAT |
| | | | | CATAACGCCTAAATATCGGTCGAAACCATAAGCTTT |
| | | | | GAAACGGCCCAAAACACGGTTTTTTTTAAAAACTTT |
| | | | | ACGACGCGAGAAATATCGTTTTGTTTATTTTGAAAA |
| | | | | CCTTTACGAAGCGACGATGCGATGCAGCCTTGTTTT |
| | | | | AACTCTATAGTGTACATAGGAATATACAATTAAGCA |
| | | | | AATAGTCGTAAGTGATATCTCAAAAGGGACAAGTG |
| | | | | TGAAATAGGCTAAAGAGTTGAATTAATTGTGGGAT |
| | | | | TGACAATTGTTTCATCACTGGTCCTCTATTGCTTTCC |
| | | | | TTGGTAAAATGTTGCATACTTGTTTATTGATTTACA |
| | | | | CTACATATAATTAGTTCTGTAGAATATGTTCTTGAG |
| | | | | TCAAAGCATGGGTCGATGTTTGAGGTTGATGTTGG |
| | | | | ATTTGCTTGGGCAAGCAATTACGAATATCTTGGTTT |
| | | | | AAGGAACCCATGAAAATGGAGCAGCTTGCAACGA |
| | | | | AAACAAAGCCCAGTTGAAAGCCTGCTCGGGTGAGC |
| | | | | AGCATCGCGTTGGGGCCAGCATGATGAGCTGTTCA |
| | | | | AACACAGAAGTTACTGGAGTGCTAGTGCTCTGGCA |
| | | | | AGCAAGCACAGCGCAGCTTACTTTTCTTTAATTTTT |
| | | | | GATTCTATCTAGAATTCTAACTAAACCCTAATGCTT |
| | | | | ACGATTGATTAGTATAATTAAAACCCATAAAGTGA |
| | | | | ATGAGTTGTTCAAATACTTGACAATTGACATTATTT |
| | | | | GAGTGGTCGTGGATGTAGTGTTGTAACAAAATTGT |
| | | | | CACTTATGAGTTAGGACCATATCCTTGCGAAGGTG |
| | | | | GAGATACACTTGGTAGAATACGGTGAAAAGTATCA |
| | | | | CCTTTCCATAGATAGTATAGCGTTATAAGTGAATTT |
| | | | | ATTATATTGTGCTGTCATATCAGTGTAACATAATTT |
| | | | | GTAGCTAATCCGCTTTTTGAATACGGAATTCGCTCG |
| | | | | AAATTGTTGAAAAATAACCCAAGACCGACCATATTT |
| | | | | TGCTTTTTTCGGTTTGCGATTCGCAGGGAGATTAGA |
| | | | | GAACCATGTAACATTGTATTTTGATATAATTTTTGA |
| | | | | ATTTCATTGTCAGTTGACATCTTGAAGCTGTTACTA |
| | | | | CCCGATACTTGGAAGGAAATCTCATACTTCAAAAA |
| | | | | GCTTGAGAAATTAGTGGGCGTTCCTGTGATTAATG |
| | | | | TTCACATATGGTTAGTTAATTCTTCATTCTATATTAA |
| | | | | ATTTACTTGTTAGGTTTTATACCTAATCAACTGCTTT |
| | | | | TAGTTTTGACATTTTGTCCGACAATAAGTGGACGTT |
| | | | | TCTGTTTTGTTGCGTTTTGTGAATTTCTTTTGATTAC |
| | | | | AGGGGCTAATTATATAATAATGCTTCATGCAGGTTT |
| | | | | GACAGAAAATTAAAGAATACATATGACCATCTACT |
| | | | | CTTCAGCAGGTAGTATTTCGTTTCTTTAATCATCCTA |
| | | | | TTTCTCTTTCGTAACTTAAATAATCTCGTTCTTCCCCT |
| | | | | TCCCTCCTTCACTTCAACACTTGTTTCAATTCTTCATT |
| | | | | TTTGGTCGTAGTAAAAACTGATGAATATTTGACAA |
| | | | | GAGTCGCATCATAAGTAATATGAACATTGGAGGAG |
| | | | | TGACAATCATCTATGAAGTATAAACTAAGATTC |
| | | | | TTTGAAGAAGGGGAAAGTTTAAGTGAAAATTTTCT |
| | | | | TTCCATTGGGAAATAAGTCTTTTGATTAACGTCTTG |
| | | | | AATAGATGAAGGATGCGAATTTTTGGATTCAAATG |
| | | | | AAGAGAAACGTTTTATGTGATCTAGTTGCGAGTCG |
| | | | | ATGGTGCCTTGAATTTCTTCAAAATTGAGCATTTTG |

TABLE 1-continued

Weed species and PDS gene sequences

| SEQ ID NO | SPECIES | TYPE | LENGTH | SEQ |
|---|---|---|---|---|
| | | | | TTAATGTTCGCTTTATTTTTGCACTTTCATGTCCTTTT
CTTAAAGTTTTATATGGCTATACATTCTCAATTTAG
GGCGACCTCGATGCTTAAACCTTTACAAACACACAT
CATATAAGAATGAGAGTGTTAAAATTTACCTCTTAA
TCTCAGTATAAAGTGTCTCCTTTACTTTTGCACAAAT
TTTAGGAACGTGTAAGTTAGGATACAAATTGAAGT
TAGGGAATCTTGTAGGGCTCATAAAAAATGACAAT
CACAAATAACTTTCTAAATATCGAAATGGGTCACTT
GTGGTGAACTGATCCAATATGAAAATTAGACACTT
GTGCTAAGATGGAGCAAGTATTATAACTTATGAAA
ACATAATACTTGGGGTGGATGTACCTTTGGTAGGA
ACCATAGTGCCAAAATGCAATTAACGGTTGCAATT
GCGGTAACGACACGATGATGCGTTTATCATAACTC
CAAATATCGGCTAAAAGCATGAGATATTCCTTGTAC
CGGCCCAAAACACGGTTTTTTTACACCTTCACATCA
CGAGAAATATCGTTTTTTTGAAAATCTTTAGAACAC
GGCCGATGCATTGCGATGCGACCTTATTTTTGCACT
ATGGTAGGGACAACATTTGCGGATGCACACATTGG
ATACCGTTTCTGACCCCCTTTTCACTTTTACAGATCC
TATGGATATAAGTATGTTACTGATTCTAAAACTTCA
TTCCCTAGGATTAAATGTAGAAACCATATAAGGAT
GGATCTTTAAGATACTTTTATCTATATCCTTTCCTGA
ACCCTATTAAATATCTATGGCCTACAAGAGGTGGTC
ACAATTCATCATCCTCTTCGTCCACTTCATGCATTTT
AAACATATCTTCGAGTTCTCCTTTAATTGTTTATCTT
TGTTATTCAGGAGTCCTCTTTTGAGTGTCTATGCT
GATATGTCGGAGACATGCAAGGTGAGCATATTCCC
ATTTGTCGCTCTTTTGATTTCTGACTTGTATGTTCTG
GTTCTCCATTTGTCGCTCTTTCGCGCGTATAATTTCG
AATGTTAGCCACTCCCCGTCACTCCTCCCATTCTGC
AATCACCGGGATTTTAACTATGAGGGTCCTTAGAA
TCGATTATAAAAATTCGACAAAAACAAAAAAAAAA
GACATAAAATTGACGGGCCATAACAATTTTACATA
AGATATTCAACATTTTTTTTGCGAATTTTCTTAATAA
ATTCCGTAATTCCGTACATCTATACTCCCGAGCCCC
TTCATGTGTGCGCTGCGGCTTTAAGAAACCTTTCTT
ATAAGTGTTGACTGTATGAGCTGACAGGCTGTCTTT
TCCGTCCCAATAATCATTTACAGGAATATAAGGATC
CAAATAGATCCATGCTGGAACTGGTTTTTGCACCCG
CGGAGGAATGGATTTCTCGAAGCGACACTGATATT
ATCGAGGCAACAATGAAAGAGCTTGCCAAGCTTTT
CCCGGATGAAATCGCTGCCGATGGAAGCAAGGCC
AAGATCCTCAAATATCATGTCGTCAAAACTCCAAGG
TGATTGATAAGCTTGTGAAATTAAAATTGGATAATT
TTATGCTACCGCTAGAAACAGCATTAATGTTGTGCC
CGCGGGCTCTTTTATAGGTCGGTTTATAAGACTGTA
CCGGATTGTGAACCTTGTCGGCCGCTGCAAAGATC
ACCAATAGAGGGTTTCTATTTAGCTGGTGATTACAC
AAAACAAAAATATTTGGCTTCTATGGAAGGTGCTG
TCTTATCTGGGAAGCTTTGTGCACAGGCTATCGTAC
AGGTAATCAAATTTTGATGGAACACCGCGTGCATG
CTGAGTAGACTTTTTGTGTTTTGATTTGTTCTGAAAT
TGACCCAAAACCGACCGGAAATCATGGGTTATAAC
TCGGAAAATATGACCCGTAACCTGAAAATGACTCA
AAACCCACCGTAGCCCAAATCCAACCGTTTCGACTT
GTTTACCTAATTTTGTCAACTTTTCTTGTTCCACATC
GTTAATTTTCTGTCGGAACCCACTTTCTTTCTAGTCT
ATTTTTGTATTTCTTTTTTCTTTGTTGATTCTTTTATT
CGTTTATACCTAGTTATGTTTTTTTTTTTGAAAATTT
GGAATAGATTAATAAAAGGAGGAAAAGAAACACA
ACACTGTAACTTGGGACACCAAACCTAGTTATGTTT
ATATATTTATATGTATTTTATATATTTATATGCTTTT
GACTACTGAGGTATTATGATAGTTTCTATGAGCGT
GATATACTGGGTATGAAGATGATTTATTCTTTTTTA
ATAAAAAAGTTTAGGTCTTTTTTGAAAACATTTTAG
TGATTTTTTCTAAACTTGTAACCCGATCGAAATTCA
ATCCGAACCAAAAATAACCCGATCGAAAGTGACTC
AACCCAAAAGCTTCCCTGATCTAATTGTGATGATAG
CTTTGAAATTTTCATCGTTTTAGTCAAAAGTTCTGT
TGAGTAGTTTAAATAACTGGTTCACATTTTGTAATT
ATATGCAGGATTATGATCTGCTGAGTTCTCGAGCA
CAAAGAGAATTGGCGGCGACAAGCAATGTATAACC
CTAAGTTGCTTCGACATCCGCCATCGATTTTCATTC
GAGATCTGGATTGGGAATCTGATCATCGAATAACG
ATCAGCTGCAAACAAAATTATGAGGGTTGCATACT |

TABLE 1-continued

Weed species and PDS gene sequences

| SEQ ID NO | SPECIES | TYPE | LENGTH | SEQ |
|---|---|---|---|---|

```
GGGGCTGTTCAAGTTCTTGATGTATAAATTCTCCAG
AAAGAAGATTTATTTGTAACGATATATAGAAATAT
GTATAGCTTACTTCTAGGGAATTATGTATGTGCACC
ATCTGTAACTTGATTGAAATGTAAGTATCAACTTGG
TCTCTTGATTGAAATGTAAGTATCAACATAATACAA
ATTTATACCAATACATTTATTTCCCTTTTTTGTTTAAT
TATGTGTTTTTTGTTGTTTTTATTTGTAACTAGAGT
CACTCATACTCCAACGGTCTGTCTGGTTTGTGGTAT
TAAACGGTGGTGATGAGAATAAAAACTAGTGTAAT
TTTGATTAAAAATTCTCTTGCTATTTTGATGGCCATG
GTTGTGTTTGATGAGAAGGAATATGAAAACTAGTG
TAGGTGGTATTAAACAGTGCCACGGTGGTAATGAG
AATGAAAACTAGTGTAATTTGGGTTAAAAAAATCT
CTTGTCTTTAATCATCTCATTTTCTTTATAAATTTCAA
TCCAATGCATTACTATCGGGAGAGATGGTATCAGG
TGGTAATGGAAATTTGTAAATAAAAAGAAAAATTT
TGTGATCAAAGTTTCATCGCTATAAAGCATTCTCAT
TACCACCATTTAGTACCACTAATCAAACAGGCCGCA
AGAGCTTTAGCGTTGGCTTCCATTGGATGATTATG
GGGGTTAACGAGTCTGTTAAGGTGCCCATTATTAT
CTATATGTAGTTGTCTTCCATTGAAACTTGATAAGT
AACTTCTACCATTACCAAGTGTTTGTATATGAATCA
TTTTTTTTTTCTCTTTGTCTGGGTTGTTCAGACTCAC
TTTTAAAATTCTTCTTCATTAGCAAGTCCATTAGACT
TGTTTCAGTGCACTTCTGATTATAGTGTAAACAGAA
ACAAGGTTGCATCACATCAACCACGTTGTAAAGATT
TTCAAAACAGACGAATTGATATTTTCGCGTTACCG
CATTTTTACATATCAAGTAGCTGTTTATTCAAGGAT
TAACAACTCATATAAAGTATCATAAGCTTATCAATA
TCTTTATGATTTATGAATGGAGTAATAAGAGAAGTT
AACTTATCTTGGTTTAGACTCTTGAGCGGAGCCGTA
CAATTACAAATCATTGACATACATGATACATTGCAT
AGGGACCCATCAAAAAATCAAAAAGGAAGACGAT
TGATCCTAAACGGAAACGAATGAAATTAAAAGAGA
GTAAAAAAAACACATTAATTTTAGAGGTTTTATATA
TTTTATATATTTTTTTTGTAATTTTAGAGCCTAAAAA
TAAGTTATTATACTCCGTCAAAGTTAGTATAAACTA
ACGTTAACAAATATTTGAAGCTCCCTTAATTTATGG
AGTTCTATGTGATTGGACATCTTACACATGCTCAGA
ACCACACCTGAATACAAAATATCAATATAATTCTGG
TATCCGAGCTGATAGTTCGATCAAAAATTAAAAAG
GTGGGTCCAAAAAGAATGTTGTCCCTACCCTAAGG
GCTAACAGTGTGTTTGGCAAGAGGGACTTGAGGTT
GGGGAATGAGATTTTTGGGTAAGATTATAAAAAGT
CTCTTATTTGTTTAAGGGGATTGAGAAAAGATGAG
ACTTGAGACTTAGAAAGGAAAAGTCCCCAAAAAAT
GTCTTGGTGGGAGGGCAGTATTTGGGGATGAAAC
TTAGAAAATTTATAAAAAGACAATTTTGCCATAAAT
GTAAAGAAATCTAAGAGTTATAAGGACAATTTTGT
AAATATAATCGATTTTTATTTAATTTCTTATCTATTTT
TATCATTTGACTGACAACGCACATAAGACATTTATTT
TCAAAGTCTCAACTCAAGTCTCAACCTAAAGTCTCA
TTCTAAGTCTCGACTATAATCTCATAATTTCCATTCC
CACATGCCAAACACCCCCTAATTGATTACTCCCACG
TTCAAACTTGACGGGATTCACATGTAAAAGAAAT
GTTGAGACAGTTTATCCCATATTGATAAATTAAAGA
TGTTGTGCACACTTTATAATTCATTAAAACTAGAGG
TGCTCATTCGGGTCATCGGGTTGATTTCAGGTTATG
TGTTTCAGGTCGGTTCAAAATCGGGATTTGTGTTCA
CATTGGCTTTTACATAATTATAGATCCACTTTTAAAT
CGGGTCTAATCGGGTTCGATTATAAAGTCGGATGT
CTATCGGGTCATCGGGTATGTTTTGAACACCTCTAA
TTAAAACCCATCCCTTCCGATCTAACTTAACATTCAT
GTACCTCGTTAAACCACAAAATCTGTTTCTAAGCTT
GTAATTTCAACAAAATCTAACCAACTTAAGTCTTAA
GTTAAAAACCAAGAGGAAAAGGGCGGTTTCAATCT
TCAATCTCGAGTGGACGCCATAACTAATGGCTGAT
GCAGATCATCTCACATTCTTAACATTTCAATTCACTG
AATCTTGGGATTTTGGTGTTTAAAAACAAGATCATG
GTAATCCTTTAAACCTTAAATTGTAATTAAAGTCAT
TAAATTTGTGGTTTTGATGTATTCAACGTTTAAAGT
ATTTAATTTACCCAAGATCAGGTAGTGGGGGATTG
TGCATTTGTGCATCAGATCAGTACAGGATTAATGT
GCAGCAACAGTTCATTCGAGTCTTAGAGGGTGAGC
GAGGGGATTGACTATATAATATAGGGCCGTCTTAT
```

TABLE 1-continued

Weed species and PDS gene sequences

| SEQ ID NO | SPECIES | TYPE | LENGTH | SEQ |
|---|---|---|---|---|
| | | | | TCTTCCGTATGAAAAAGTTAACAAGAAATGTATGTT<br>AAGTCTATTAATAAAATAAAAATATTACTACAAATA<br>AAGTGCAAATAAAAGTTTTACACAGGGCCCCTAAA<br>TTTTTCAAAACGGCTCTCAGCCACACAAGTAGACAG<br>TCATCAGCCGAGTACTTCCTCCGTCTAACAAATTGT<br>GACAGTGAGGATAAATATAGTTAATTATGTCCAAA<br>ATTTATAATATAAATATAAAGATTTCGTAGGTGAAC<br>TGTAAATAAATCAACCCAAAATAACAATACAAATTT<br>TTGTGAGAGATGGTCTCTTTGAGAGACCATCTCTA<br>GTTGGGCGGCTCATTATATATTTTTTAAAATATTGT<br>AAGTAGGCATTAGGAATGATCTAAGTATACATTTA<br>AGATATTGAAAGTAGGCATTAAGGATACGATAATA<br>AGTAAGCACTAAGGATAATGTTAGTAGACATTAAA<br>AATATGATAAATAGACATTAATCTTTAATGGGTTGG<br>ACTTGAGATATATTTTTCAAAGAGACGATCTCTCAA<br>GAGATTAGCTGAAATACCAATGAGAACAAATTTAA<br>CAAACGAAAAGAGTAATAAATATATGAGGAGTTAA<br>AACTTAAAATGCATGTGAGAACAAAAATGCAAGAA<br>AATGATGAAACATTTTTATAAAGGAGAATTGTAGC<br>AAAATAAAAAGAATGAACAAAAGTAAAAGGTATTT<br>CCTCTGTTTCATAATCGTTGCTAGCGTTAGTGACAT<br>TTTCTAACATAACATGTCACACTAATGGAGAAAGTA<br>TTTGACAAGTCTCTTAGTCAATTGAAAGCATATTTC<br>TTAGGAAAAAGATGAGCTGAGTTTGTTCAGTGATT<br>TGATGATGTGATCAAATCATTAGTGAATCAGTGAA<br>ACCATACTCATGATTATATGATTACAACTTTAACAA<br>ACAAGTAAATATTGCATCTTTGGAGATATCAATGA<br>GTCAATTGACTAATGAATGTTCTAAAAGACTAAACA<br>CAAAAGATTGCACCAACTCATAACACCCCATCTATC<br>TATCTTTTTAATTTAGTATCATTTTTTATTTTGGGTTA<br>TTCGTCTCATTTGTATTAATAATACATCACTTTCTTT<br>GAACCTTATTCATACATTTTAACCCTTTTTTTAATAT<br>CATCCACGCAATTCAATCTCTTTTGGCTTATTACCAA<br>TAAGACTCAAAAAAATGTACGACCTTAACAAAGAA<br>ATTTATTGTCGATTAAATCATCATCATCATACCC<br>AGTGTATCTCGCTCATTATTGTCGATTAAATCTTAAT<br>AGAAAATATTATGTACAACTTCACATAAATAATAAA<br>TTAGAAATACTCATAATTTAGTAAGTCATTTTACTAT<br>ACTTCATATAAATATAAAGAATTTTAATAAAATTTTC<br>CATCACCTCTTATTATCGGAAATTCTCTAACCTGCAC<br>CCGAGTCAAAAAATTAAAAAAATAATAAATTGCAA<br>AAGCAAAAACCTTTATCAACCACAAGACTGAAAAA<br>ATAGTAATTAATTTGTCACCAAAGATATATTATATG<br>AATAATAACTAATTAGTGTTGTTTTTAGGATATAT<br>GCATTTAAAAAATGTTACCTTATGATTAGCAAAATC<br>AAGCAACAAAACTATATGATGATTTAAGTTTGTCTC<br>ATTTGAGACCATCCAACAAGAAGTCATGTGGAAAA<br>TCCTAAACTATAGTGATTAGAAAGACTAGTATACCA<br>AATCTTTGAATAAGATGACAAAAGATATTGATTAA<br>ACTAATCTTAATTAGCTATATCCAAAATATTTGGCG<br>ATTTATGGCGTTTGATAAATGACTGATAGCTGGTA<br>GTTGATAACTGATTATAGTGACTGATTTGATCAGTT<br>GATTTTATTAACTGTTTCAACCAGTTAATTCACCAA<br>AGACTAGCATTAGCTGGTTTGACCACCCAACCCTTA<br>TTTATATCAAAATAAGCTAAAATTACCCAATAAGCT<br>AATTTGTCAAATACCCGTGTATATTATGTAAGTTTG<br>AGAGTAAAAATATTTTTTTTAGAAAAAATATTAAT<br>TTAACTTTTACTTATCTTGCCTTTCCTCGGCCTATCG<br>ATTCAGTAATAAAAAAATTCTCTCAATATAATGTT<br>ATAGAAATATACTCTCTGTTCTTTTAAGTTTGTTC<br>ACATTACTCTAACGGGCAGTTTCATATGTTTGTCCT<br>ATTTAGAATACTTTTCTATTTTGGAAAGTTTTTATCT<br>TCCATGTGCTCTCTTTATCCCTCATTTAACCC |
| 8 | Amaranthus palmeri | Genomic | 8797 | AGGGATAAATGATAAAGATTGATTCATTTTTTTAA<br>ATGAATAATTTGTTTTTTTGTATGATGCAGGTTGTTT<br>GTATAGATTATCCTAGGCCAGAGCTTGAAAGTACA<br>TCCAATTTCTTGGAAGCCGCCTACTTATCTTCTACTT<br>TTCGGAATTCGCCTCGTCCTCAGAAGCCATTAGAA<br>GTTGTAATTGCTGGAGCAGGTGAGTGGAAGGGTT<br>CTTTACTCATTCTGTTCATTAGGGTCTTGTTGTGTTG<br>CTTTTTGCTTTGCCAAATTGGATGCTGTTCTTGATTT<br>TCAGGAGCTTTGGGCAAAATAGAAGCAAATTGAA<br>AGCTAATTGAGTCAATTGAGATGTTTTTGAGAAATC<br>ATTTGTTGGCCGTTACTGTTTATTAGAGAAAAATA |

TABLE 1-continued

Weed species and PDS gene sequences

| SEQ ID NO | SPECIES | TYPE | LENGTH | SEQ |
|---|---|---|---|---|
| | | | | TGGGTCAAGAAACGAAAAGATAATGGAAAAACTA |
| | | | | CTTATAGGTGTCTTTTTTGATCATGAATCATGATGG |
| | | | | ATATATATGGTGTCAACTATCAAGACTGCCATATAA |
| | | | | CTAATGTAGTATGCTTCCTTAAGGGGTGGTGAAGA |
| | | | | ATAGACGTGTGGATGAGAAAATTGCTGGGAATTTC |
| | | | | CTATGCTTATGTAGAATGAGCTTCCTCTTGTTGACA |
| | | | | TTAGTGAAAAGTGAAAAATTGGTGTATGAGTTTGC |
| | | | | TTGATCGCTTTTGTGAGTGCTTCATTGTCCGTTCCAC |
| | | | | ACCTAGGTTATGTTGTAGGGTTGCAATATGTTAAAT |
| | | | | TGTTAGTGACGGCTGTCGTATAACATTATTGTATCT |
| | | | | TATGCCATGGGCCAAATTTACCCCTATTCAACGACG |
| | | | | CCATGCAGACCTAGGTGTAGTGAAAAGTATGCAAG |
| | | | | GGTTAATTGGACATCAAGCATGGCGCCATGTTGTT |
| | | | | TGAGTGTGGCAAAAGACTTTACGCTACACCTCTA |
| | | | | GACCAGTTAAGTATGTAAAGGGTGTTGGGTCACCG |
| | | | | CTCTAAAGTGGTGTGTCACATTTTATCGAATTCGAG |
| | | | | GATAAGCTGATCGTGGTATCAAGTGAGAAAGAAC |
| | | | | GCAATATAGTGGAATTAGAAAGTTAAGTAATAAGA |
| | | | | AAAAAGAAAAAAATGATATCTAGCTTTAGGAAAAT |
| | | | | CTATCAGTGAGGAGAATATTGCAAAATATGTGGAA |
| | | | | ATTAAAACCAAGACAAAGCTAGCGATATATGAGAC |
| | | | | AAAGTTAAAAATGTACAAAGAAATATACGATAAGT |
| | | | | TGACTCGAAAGAAGAGGATAACGATCTTTATAGGA |
| | | | | TAGCCTAAAGGAGACAAATGATTATAAACGATACT |
| | | | | AGTTGAATGAACTATGAAGAGTGTCTTAACCAAGC |
| | | | | AAATATTGTTTAGAAATAGATTCAGAACTTTTTAAT |
| | | | | TCTTCAAATGTGAACGTGAGAACTGACTTCTCATTC |
| | | | | TTTATTTTACTTCAAGGTTTGGCTGGTTTATCCACG |
| | | | | GCAAAGTATTTAGCTGATGCAGGTCACAAACCCAT |
| | | | | ATTGTTGGAAGCACGAGATGTTTTAGGAGGAAAG |
| | | | | GTGTGTGCTATACGTTTCTCATAGCTTATGAAATAA |
| | | | | ATTCATCGTGGTTACTCTCTTATTAGCTTATTTCAGA |
| | | | | CTATCAAATAATTTTTGAACTTTTTCCTCCCTCTGTT |
| | | | | CGGCTGTATTATTATATATGTGCAGCATGATTAAAA |
| | | | | CTGGGTTCATTAAAATATATGAAGTTTTTTTTATCA |
| | | | | AGGCGAGATTTTGTCATCCAAAAACTTTACTTCTGA |
| | | | | ACGTGCTGTATGATCCTGTTTCTGTATCTTCATTTGC |
| | | | | TGGGATTTTCTTGAGGTTCCTGACTGCTTTCAGTTA |
| | | | | TTGTAGTTACCCATCCTGCATAAGTCTGAGTTTACA |
| | | | | GTTATTATAATGAAAATGAATCGGCTAATTATATCC |
| | | | | TCATCACAGTATGATGAATCTTGGGCTAGTATGAA |
| | | | | AATGAGGTAGGAAGAATAATTTGGGTTAGTTTCGT |
| | | | | AATATGTGCCAAGAGAAATATTGTAGTGCAAAGTT |
| | | | | TCTTTGTATTTCTTCTCGTGCTTATATTTTTTGCTCCA |
| | | | | CAGGTTGCAGCGTGGAAGGATGAGGATGGTGACT |
| | | | | GGTATGAGACTGGGCTACATATATTCTGTGAGTGA |
| | | | | TCTTCTAATTTTCTGCTTAATTGGCCAGTTACCCATG |
| | | | | TTCTTACAATGCGCTCTCTAGTCGTGTTTATTGGAA |
| | | | | AATCGATGTACTGAACATCTTCATATTTTCTTGAAG |
| | | | | TTGGGGCATATCCAAATATCCAAAATCTATTTGGAG |
| | | | | AACTTGGTATAAATGACCGACTGCAATGGAAGGAG |
| | | | | CACTCTATGATTTTTGCAATGCCTAGCAAGCCCGGT |
| | | | | GAATTCAGTCGCTTTGATTTTCCCGAAATCCTGCCT |
| | | | | GCACCATTAAATGGTTAGTATATCGGTGATAACTG |
| | | | | CCAAATTACTTGATGCAATGCAGTACCTTGTTAAGT |
| | | | | ACTTTGGATGTGACTCCACCTATAATACTTGCTATA |
| | | | | ATCTTCAATTTATTTCTCTTTCCTACATTAGAAACTA |
| | | | | TAAGTATCCCGCTAAAGGACATGACCCCACTTACAA |
| | | | | AGTTACAATACCCCATGAAAATACCCACTCACCCAC |
| | | | | TTTTTTTAATCGGTGTACCATCCGCCCGAGGAGCAA |
| | | | | TCTCGAGGGGACAGCAGAGTACTACTTTAGTGTTA |
| | | | | TTGTGATGAAATAGGTACCTGCATCATATCTCATGT |
| | | | | CCTGTGGATACCCATAAATGAACGAAAAATTTCATT |
| | | | | TTTATACATATTATCCTGCTTTAGAAGCTTGGAATA |
| | | | | TCATTGAACTTTTTTAACGTCCCACCATGAAAACAA |
| | | | | TCTGCATCTTGGTCTGTTTGCAACTCCTAAATCCTAA |
| | | | | TGAGTCGGGCTGATTTATGTCTTTGATGCTTTTGAC |
| | | | | CGTGTTTGGCAGGCATATGGGCAATCCTAAGGAAT |
| | | | | AATGAAATGCTAACCTGGCCAGAAAAAATCAAGTT |
| | | | | TGCCATTGGCTTGTTGCCTGCTATGGCAGGCGGAC |
| | | | | AGTCATATGTTGAAGCACAAGATGGTTTGAGTGTC |
| | | | | CAAGAGTGGATGAGAAAACAAGTAGGAGCAGACT |
| | | | | TTCGTTTCAGATTTTCCTCATTTTGTTAATGGTTCTA |
| | | | | GCTGTAAACTTTGACTTTGTTGGGACGTCAATGCTG |
| | | | | AAATTTTGTTTGTGCATTAATGCAGGGAGTACCCG |

TABLE 1-continued

Weed species and PDS gene sequences

| SEQ ID NO | SPECIES | TYPE | LENGTH | SEQ |
|---|---|---|---|---|

```
ATCGTGTAACTGATGATGTGTTTATTGCCATGTCAA
AGGCACTGAACTTCATAAATCCCGATGAACTTTCAA
TGCAGTGCATCTTGATTGCTCTGAACCGATTCCTGC
AGGCATGACTGCTTTTTAATTTCCGCTTTAAATTTTT
GGTTTTGTACAATACTTCTTAGTGCTTGTTTTTGTGA
CTTTTCTCGAGTAAATAGGGGATGTAAAATGACCG
TGCTGTTTTTCATGAACTGACGTTGGGTAATGTATA
TCAACAGGAGAAACATGGTTCTAAGATGGCCTTCC
TAGACGGAAACCCTCCAGAGAGGCTGTGCATGCCT
ATTGTTAAGCACATCGAGTCACTAGGTGGTGAAGT
TAAACTAAATTCTCGTATACAAAAGATTCAGTTGGA
CCAGAGTGGAAGCGTGAAGAGTTTTTTGCTAAATA
ACGGGAGGGAAATACGAGGAGATGCCTATGTTTTT
GCCACCCCAGGTTTTCTTCTCTCCCTTTTTTACCATT
AGTTTTCTATTAGACTCAGTAAAAGCTAGAGTAAA
GAAAATGAAGATTCTATTACAGAAATGGACACACT
GTAAAGCTTAATTAGTTTTGATCTTGGGCAAAGCAT
TTGTGTTTCCAAATTTGTTAATGGTTATTATTTAAAT
AGAACACTTATGTTTGTGATGGGTAACAATAGGTC
AAGCGTTGAGCCAAAGTGTTATAACAATGATTATA
TAGTGTATATCATAGTGTAAAATTGCGGTAACGGA
CGCAATCACAGTGTCGGGAGTGATTCGGTATCATA
ACGCCTAAATATCGGTCGAAACCATAAGCTTTGAA
ACGGCCCAAAACACGGTTTTTTTAAAAACTTTACG
ACGCGAGAAATATCGTTTTGTTTATTTTGAAAACCT
TTACGAAGCGACGATGCGATGCAGCCTTGTTTTAA
CTCTATAGTGTACATAGGAATATACAATTAAGCAAA
TAGTCGTAAGTGATATCTCAAAAGGGACAAGTGTG
AAATAGGCTAAAGAGTTGAATTAATTGTGGGATTG
ACAATTGTTTCATCACTGGTCCTCTATTGCTTTCCTT
GGTAAAATGTTGCATACTTGTTTATTGATTTACACT
ACATATAATTAGTTCTGTAGAATATGTTCTTGAGTC
AAAGCATGGGTCGATGTTTGAGGTTGATGTTGGAT
TTGCTTGGGCAAGCAATTACGAATATCTTGGTTTAA
GGAACCCATGAAAATGGAGCAGCTTGCAACGAAA
ACAAAGCCCAGTTGAAAGCCTGCTCGGGTGAGCAG
CATCGCGTTGGGGCCAGCATGATGAGCTGTTCAAA
CACAGAAGTTACTGGAGTGCTAGTGCTCTGGCAAG
CAAGCACAGCGCAGCTTACTTTTCTTTAATTTTTGAT
TCTATCTAGAATTCTAACTAAACCCTAATGCTTACG
ATTGATTAGTATAATTAAAACCCATAAAGTGAATGA
GTTGTTCAAATACTTGACAATTGACATTATTTGAGT
GGTCGTGGATGTAGTGTTGTAACAAAATTGTCACT
TATGAGTTAGGACCATATCCTTGCGAAGGTGGAGA
TACACTTGGTAGAATACGGTGAAAAGTATCACCTTT
CCATAGATAGTATAGCGTTATAAGTGAATTTATTAT
ATTGTGCTGTCATATCAGTGTAACATAATTTGTAGC
TAATCCGCTTTTTGAATACGGAATTCGCTCGAAATT
GTTGAAAAATAACCCAAGACCGACCATATTTTGCTT
TTTTCGGTTTGCGATTCGCAGGGAGATTAGAGAAC
CATGTAACATTGTATTTTGATATAATTTTTGAATTTC
ATTGTCAGTTGACATCTTGAAGCTGTTACTACCCGA
TACTTGGAAGGAAATCTCATACTTCAAAAAGCTTGA
GAAATTAGTGGGCGTTCCTGTGATTAATGTTCACAT
ATGGTTAGTTAATTCTTCATTCTATATTAAATTTACT
TGTTAGGTTTTATACCTAATCAACTGCTTTTAGTTTT
GACATTTTGTCCGACAATAAGTGGACGTTTCTGTTT
TGTTGCGTTTTGTGAATTTCTTTTGATTACAGGGGC
TAATTATATAATAATGCTTCATGCAGGTTTGACAGA
AAATTAAAGAATACATATGACCATCTACTCTTCAGC
AGGTTGTATTTCGTTTCTTTAATCATCCTATTTCTCTT
TCGTAACTCTTAAATAATCTCGTTCTTCCCCTTCCCT
CCTTCACTTCAACTTGTTTCAACTCTTCATTTTCGGT
CGTAGTCAAATTTGATGAGTATTTGACAAGAGTTG
CATCATAAGTAATATGAACATTGGAGGAGTGACAA
TCATCATTTATGAAGTATTAACTAAGATTCCTTTAA
GAAGGTGAAAGTTTTAAGTGAAAATTTTCTTTCCAT
TGGGAAATAAGTCTTTTGATTAATGTCTTGAATAGA
TGAAGGATGCGAGTTTTTGGAATGAAGAGAAACG
TTTTATGTGATCTAGTTGCGAGTCGATAGTGCCCTG
AATTTCTTCAAAATTGAGCATTTTTGTTATCGTTCGC
TTTATTTTTGCACTTTCATGTCCTTTTCTTAAAGTTGT
ATATGACTTTCATTCTCAACTTAGGCTTACCTCGAT
GCTTAAAGTGTCTCCTTTACTTTTGCCCAAATTTTAG
GAACGTGTAAGTTACAGGATACAAATTAAAGTTAG
```

TABLE 1-continued

Weed species and PDS gene sequences

| SEQ ID NO | SPECIES | TYPE | LENGTH | SEQ |
|---|---|---|---|---|
| | | | | GGAATCGTGTAGGGCTCGTAAAAAATGACAATCAC CAATAACTTTCTAAATATCAAAATGGGTCACTTGTG GTGAACTGATCCATATGAAAATTAGACACTTGTGCT GAGATGGAGCAAGTATTATAACTTATGAAAACATA ATACTTGGGGTGGATGTACCTTTGTTAGGAACCAT AGTGCCAAAATGCAATAACGCCATAACGGTAACGA CACGATGATGCGTTTATCATAACTCCAAATATCGGC TAAAAGCATGAGATATTCCTTGTACCGGCCCAAAA CAGGGTTTTTTTACACCTTTACATTATGAGAAATAT CGTTTTTTTTTTTTTTGAAAATCTTTAGAACACGAC CGATGCAGCGCGATGCGACCTTATTTTTGCACTATG GTAGGGACAGCATTTGCGGATGCACACATTGGTTA CCATTTCTGACCCCCTTTTCACTTTTACAGATCCTAT GGATATAAGTATGTTACTGATTCTAAAACTTCATTC CCTAGGATTAAATGTAGAAACCATATAAGGATGGA TCTTTAAGATACTTTTATCTATATCCTTTCCTGAACC CTATTAAATATCTATGGCCTACAAGAGGTGGTCAC AATTCATCATCCTCTTCGTCCACTTCATGCATTTTAA ACATATCTTCGAGTTCTCCTTTAATTGTTTATCTTTG TTATTCCAGGAGTCCTCTTTTGAGTGTCTATGCTGA TATGTCGGAGACATGCAAGGTGAGCATATTCCCAT TTGTCGCTCTTTTGATTTCTGACTTGTATGTTCTGGT TCTCCATTTGTCGCTCTTTCGCGCGTATAATTTCGAA TGTTAGCCACTCCCCGTCACTCCTCCCATTCTGCAAT CACCGGGATTTTAACTATGAGGGTCCTTAGAATCG ATTATAAAAATTCGACAAAAACAAAAAAAAAAGAC ATAAAATTGACGGGCCATAACAATTTTACATAAGAT ATTCAACATTTTTTTTGCGAATTTTCTTAATAAATTC CGTAATTCCGTACATCTATACTCCCGAGCCCCTTCA TGTGTGCGCTGCGGCTTTAAGAAACCTTTCTTATAA GTGTTGACTGTATGAGCTGACAGGCTGTCTTTTCCG TCCCAATAATCATTTACAGGAATATAAGGATCCAAA TAGATCCATGCTGGAACTGGTTTTTGCACCCGCGG AGGAATGGATTTCTCGAAGCGACACTGATATTATT GAGGCAACAATGAAAGAGCTTGCCAAGCTTTTCCC GGATGAAATTGCTGCCGATGGGAGCAAGGCCAAG ATCCTCAAATATCATGTCGTCAAAACTCCAAGGTGA TCGATAAGCTTGTGTAATTAAAATTGGATAATTTTA TGCTACCGCTAGAAACAGCATTAATGTTGTGCCCG CGGGCTCTTTTATAGGTCGGTTTATAAGACTGTACC GGATTGTGAACCTTGTCGGCCGCTGCAAAGATCAC CAATAGAGGGTTTCTATTTAGCTGGTGATTACACAA AACAAAAATATTTGGCTTCTATGGAAGGTGCTGTCT TATCTGGGAAGCTTTGTGCACAGGCTATCGTACAG GTAATCAAATTTTGATGGAACACCGCGTGCATGCT GATTAGACTTTTCGTATTTTGATTTGATTTGAAATTG ACCCAAAACCGACCGGAAATTAGTGGGTTACTTAT AACTCAGAAAATATGACCCGTAACCTGAAAATGAC TCAAACCCACCGTAGCCCAAATCCAACCGTTTTGAC TTGTTTACCTAATTTTGTCAACTTTTCTTGTTCCAAG TCATTAGTTTTCTGTCGGAACCCACTTTCTTTCGAGT CTTTTTTTGTATTTCTTTTATCTTCGTTGATGCTTTTA TTCGTTTATACCTAGTTATGTTGATATATTTATATGT ATATATTTATTTATATGCTTTTTACTACTGAGGTATG ATGTTCTAGAGTATGATGATGATGATTATTCTTTTT ATATTAAAAAAAAAGTTTAGGTCTTTTTGAAAACAT TTTAGTGATTTTTTCTAAACTTGTGACCCGATCGAA ATTTGATCCGAACCAAAAATAACCCGATCAAAAGT GACTCAACCCGAAACCTACCCTGATCTAATTGTAAT GATAGCTTTGAAATTTTTATCGTTCTAGTTAACAAG TTCTGTTGAAGTTAATATAAATCTCGAACGTTCCTA TAAACTTATTTTTTAGATTGTCAAGGTTAGTTAGTT GTATAGAAGTTAAGTAGCTTAAACAACTAGTCCAT ATTTTGTATATGTGTAGGATTATGATCTGCTGAGTT CTCGAGCACAAAGAGAATTGGCGGCGACAAGCAA TGTATAACCCTAAATTGCTTCGACATCCGCCATCTA TTTTCATTCGAGATTTGGATTGGGAATCTGATCATC GAATAACGATCAGCTGCAAACAAAATTATGAGGGT TGCATACTGGTGCTGTTCAAGTTCTTGATGTATAAA TTCTCCAGAAAGAAGATTTATTTGTAATGATATATC AATTGATAGAAATATGTATAGCTTACTTCTAAGGAA TTATGTATGTGCACCATTTGTAACTTGATTGAAATG TAAGTATCAACTTGGTCTCTTGATTGAAATGTAAGT ATCAACATAATACAAATTTATACCAATACATTTATTT CCCTTTTTTGTTTAATTATGTGTTTTTTGTTGTTTTTT |

TABLE 1-continued

Weed species and PDS gene sequences

| SEQ ID NO | SPECIES | TYPE | LENGTH | SEQ |
|---|---|---|---|---|
| | | | | ATTTGTAACTAGAGTCACTCATACTCCAACGGTCTG<br>TCTGGTTTGTGGTATTAAACGGTGGTGATGAGAAT<br>AAAAACTAGTGTAATTTTGATTAAAAATTCTCTTGC<br>TATTTTGATGGCCATGGTTGTGTTTGATGAGAAGG<br>AATATGAAAACTAGTGTAGGTGGTATTAAACAGTG<br>CCACGGTGGTAATGAGAATGAAAACTAGTGTAATT<br>TGGGTTAAAAAAATCTCTTGTCTTTAATCATCTCATT<br>TTCTTTATAAATTTCAATCCAATGCATTACTATCGGG<br>AGAGATGGTATCAGGTGGTAATGGAAATTTGTAAA<br>TAAAAAGAAAAATTTTGTGATCAAAGT |
| 9 | Amaranthus palmeri | Genomic | 1788 | TTGAAAGCCTGCTCGGGCACGACACTGTAGGGCTC<br>GGGCGAGCAGCATCGCGTTGGGGCCAGCATGATG<br>AGATGTTCAAACACAGAAGTTACTGGAGTGCTAGT<br>GCGCGGCTTACTTTTCTTTAATTTTGATTCTATCTAG<br>AATTCTAACTAAACCCTAATGCTTACGATTGATTAG<br>TATAATTAAAACCCATAAAATCTTCAGATTTTTCACC<br>ACAAAATATTTGAGCTTAGTAATCTACAAGAAATCT<br>TCAAACACATCAAATCTAGTTGTCTCTCATTCTCTAT<br>TGTAATTCTTATTATTACGAGTTCTTGTGTTCAAGA<br>ACTACAAGTTTGATTATTAATCAACCCAAGAAGTTC<br>GCCAAGGAGGATGTAGCCCAAACTGGGTGAACCTC<br>GGTAAATCTTTGAATTCTTCCTTGCTTTCTACTAATT<br>AATTGCGAATGAGTATGTAAGATATTGCATTATATT<br>TTTCATATTCAACAAAAGCATTCTACTACCAATCTTC<br>GTCTTGTAATTCGCTTTTGCAACGTTGTCCTTCAACT<br>AGTGAATGAGTTGTTCAAATACTTGACAATTGATAT<br>TATTTGAGTGGTCGTGGATGTAGTGTTGTAACTAA<br>ATTGTCACTTATGAGTTAGGACCATATCCTTGCAAA<br>GGTGGAGAGATCACTTGGCAGAATTCGGTGAAAA<br>GTAGCACCTTTCCATAGATAGTATAGCGTTATGAGT<br>GAATTTATTATATTGTGTTGTCTTATCAGTGTAACAT<br>AATTTGTAGCTAATTCGCTTTATGAATTCGGAATTC<br>GCTCGAAATTGTTGAAAAATAGCCCAAGACCGACC<br>ATATTTTGCTTTTTTCGATTTGCGATCCGCAGGGAG<br>ATTAGAGAACCATGTAACATTGTATTTTGATATAAT<br>TTTTGAATTTCATTGTCAGTTGACATCTTGAAGCTG<br>TTACTACCTGATACTTGGAAGGAAATCTCATACTTC<br>AAAAAACTTGAGAAATTAGTGGGCGTTCCTGTGAT<br>TAATGTTCACATATGGTTAGTTAATTCTTCATTCTAT<br>ATTAAATTTACTTGTTAGGTTTTATACCTTATCAACT<br>GCTTTTAGTTTTGACATTTTGTCCGACAATAAGTGG<br>GCGTTTCTGTTTTGTTGCGTTTTGTGAATTTCTTTTG<br>ATTACAGGGGCTAATTATATAATAATGCTTCATGCA<br>GGTTTGACAGAAAATTAAAGAATACATATGACCAT<br>CTACTCTTCAGCAGGTTGTATTTTGTTTCTTTAATCA<br>TCCATTTCTCTTTCGTAACTTAAATAATCTCGTTCTT<br>CCCCTTCCCTCCTTCACTTCAACACTTGTTTCAATTCT<br>TTCATTTTCGGTCGTAGTAAAAATTGATGTATATTT<br>GACAAGAGTTGCATCATAAGTAATATGAACATTGG<br>AGGAGTGACAATCATCATTTATGAAGTATAAACTA<br>AGATTCCTTTAAGAAGGTGAAAGTTTAAGTGAAAA<br>TTTTCTTTCCATTGGGAAATAGTCTTTTGATTAACAT<br>CTTGAATAGATGAAGGATGCGAGTTTTTGGAATGA<br>AGAGAAATATTTTATGTGATCTAGTTGAGAGTCGA<br>TGGTGCCTTGAATTTCTTCAAAATTGAGCATTTTGT<br>GAACGTTCGCTTTATTTTTGCACTTTCATGTCCTTTT<br>CTTAAAAGTAGTATATGGCTTTTCATTCTCAACTTA<br>GGCTTACCTCAATGCCTAAACCTTTACAAACACACA<br>TCATATAAGAATGAGTGTTAAAATTTACCTCTTCAT<br>CTCAGTAAAGTGTCTCATTTACTT |
| 10 | Amaranthus palmeri | Genomic | 1277 | ACCCATAAGGAGAGGGCGGTCACAAGAGTCCTTCG<br>GTTAAGAGGAGTCTTCAAGGATAAGACCTGCAAAT<br>ATCCGAAAACCTAGTACCTATGGACTATAATTGTGT<br>TGGATAAAATAACAATTAGTTCATATTGGACTATAA<br>TTTTACCCTAGTGCCTATGGAAGATTGGGGAAATA<br>ATTTAATCATACTCCTTTTTTATTCATCTTTTTTATTT<br>ATTCTCATGCTATTTCTTTCACAATGTTTCAATTACC<br>TCACTTGCACTTCTACTGGCCTTTATTTCAATAATTT<br>AACTTTTTTTCACCCTTCAATATTTACAATCAATCCA<br>AGCGAGCACTAAGAAAAAAACATTTGGCTTGATA<br>TATACTAATTTACCATAATAAAATCCAAACCTGCCA<br>AAAAAACATTTAGTTATTAAAAATGCTATGAAAATA<br>GTCTTTTTTTTCTCAAGTGAAGTTCTGTAAATTAAA |

TABLE 1-continued

Weed species and PDS gene sequences

| SEQ ID NO | SPECIES | TYPE | LENGTH | SEQ |
|---|---|---|---|---|
| | | | | AAAAGAAAAGCAAAGTAAATTACCTGGACCGTTGT<br>TGCGGTGGAGGAAAGTTCCAACGGGACTTTTGATC<br>TTAGTACCAAACACCGGTTCAATGAAGTTCAAGAA<br>TACCGACTCATCATTGTTGGCTAAAACCACAGCCTG<br>AAGTGCTGAATCAGCTACACCAAGCAGATCATCCG<br>CACTAAACTCAGCAAACTCATGAAACCCACTTATCT<br>TTCTTACATACTCCCACACCGGGTTTAACTCTTCCAC<br>ACAACTTGCAGCATGGTCTATTCCCTTTATCCCAAA<br>CTCCTCTACTCTTCCAACCTCTACTCTTGCAAACTTA<br>GCAAGCCGCCACAAATTACCCCACTCTTTTTCATTTT<br>CAGATGAATGGCTCACAAATCGTAGGACTACGTCA<br>TTATACAGAATGACTTCCGCAAGCATCGTGTGTCCG<br>TCTTCAAGCAGGACAGGCGGGGCTGACGGATTAG<br>CTCCTGCAGCAACGCTAATCCTAAAGGCGGATTCA<br>GCGTTCTCCACTTCAAGGGCCACAGCGCGAACACC<br>AAGCCCATGAGAACACACAAAAGAGGCGTGCGCA<br>CTGTGGTCAAATGTAGGAATTGAAGCAGTGTTGAG<br>CTTAGATGAAGCAGAGTAAGGAGCCGTGAATACG<br>AAACAAAGGTCGCCACTACGTAAGACGTAGGAGG<br>CATGTACAAGGTTGCCTGTCGAGAGATCGGATTTG<br>GCAACCAAAGGCATGCCAAGCCCTAACGAAAATAA<br>AAGGCTAGTGTTGGTTGCATCACCACACCAGAACT<br>CAATGTGGTGGAACCTTTTCACTTTGAAATG |
| 11 | Amaranthus palmeri | Genomic | 1241 | GATATACTGGGTATGAAGATGATTTATTCTTTTTTA<br>ATAAAAAAGTTTAGGTCTTTTTTGAAAACATTTTAG<br>TGATTTTTTCTAAACTTGTAACCCGATCGAAATTCA<br>ATCCGAACCAAAAATAACCCGATCGAAAGTGACTC<br>AACCCAAAAGCTTCCCTGATCTAATTGTGATGATAG<br>CTTTGAAATTTTCATCGTTTTAGTCAAAAAGTTCTGT<br>TGAGTAGTTTAAATAACTGGTTCACATTTTGTAATT<br>ATATGCAGGATTATGATCTGCTGAGTTCTCGAGCA<br>CAAAGAGAATTGGCGGCGACAAGCAATGTATAACC<br>CTAAGTTGCTTCGACATCCGCCATCGATTTTCATTC<br>GAGATCTGGATTGGGAATCTGATCATCGAATAACG<br>ATCAGCTGCAAACAAAATTATGAGGGTTGCATACT<br>GGGGCTGTTCAAGTTCTTGATGTATAAATTCTCCAG<br>AAAGAAGATTTATTTGTAACGATATATAGAAATAT<br>GTATAGCTTACTTCTAGGGAATTATGTATGTGCACC<br>ATCTGTAACTTGATTGAAATGTAAGTATCAACTTGG<br>TCTCTTGATTGAAATGTAAGTATCAACATAATACAA<br>ATTTATACCAATACATTTATTTCCCTTTTTTGTTTAAT<br>TTTGTGTTTTTTGTTGTTTTTAATTTGTAACTAGACT<br>CACTCATACTCCAACGGTCCGTCTGGTTGGTGGTAT<br>TAAATGGGGTAATGAGAATAAAAATTAGTGTAATT<br>TTGGTTAAAAAATCTCTTGCTATCTTGATGGCCATG<br>CTTGTATTTGATGAGAAGGAATATGAAAACTAGTG<br>TAGGTGGTATTAAACAGTGTCACGGTGGTAGTGAG<br>AATGAAAACTAGTGTAATTTGGGTTAAAAAATCTC<br>GTCTTTAGTCATCTCATTTTCTTCAGAAATTTCATCT<br>CAATGCATTACTATCGGGAGAGATGGTATTAGGTG<br>GTNNNNNAAATTTGTAAATAAAAAAAACTTTTTGT<br>GATCAAAGTATCATCACTATAAATCATTCTCATTAN<br>NNNNNNTTAGTACCACTAATCAAACAGGCCGCAA<br>GAGCTTTAGCGTTGGCTTCCATTGGATGATTATGG<br>GGGTTAACGAGTCTGTTAAGGTGCCCATTATTATCT<br>ATATGTAGTTGTCTTCCATTGAAACTTGATAAGTAA<br>CTTCTACCATTACCAAGTGTTTGTATATGAATCATTT<br>TTTTTTTCTCTTTGTCTGGGTTGTTC |
| 12 | Amaranthus palmeri | Genomic | 714 | CTAATTATATAATAATGCTTCATGCAGGTTTGACAG<br>AAAATTAAAGAATACATATGACCATCTACTCTTCAG<br>CAGGTTGTATTTTGTTTCTTTAATCATCCTATTTCTCT<br>TTCGTAACTTAAATAATCTCGTTCTTCCCCTTCCCTC<br>CTTCACTTCAACACTTGTTTCAATTCTTCATTTTCGG<br>TCGTAGTAAAAATTGATGTATATTTGACAAGAGTT<br>GCATCATAAGTAATATGAACATTGGAGGAGTGACA<br>ATCATCATTTATGAAGTATAAACTAAGATTCCTTTA<br>AGAAGGTGAAAGTTTAAGTGAAAATTTTCTTTCCAT<br>TGGGAAATAGTCTTTTGATTAACATCTTGAATAGAT<br>GAAGGATGCGAGTTTTTGGAATGAAGAGAAATATT<br>TTATGTGATCTAGTTGAGAGTCGATGGTGCCTTGA<br>ATTTCTTCAAAATTGAGCATTTTGTGAACGTTCGCT<br>TTATTTTTGCACTTTCATGTCCTTTTCTTAAAAGTAG<br>TATATGGCTTTTCATTCTCAACTTAGGCTTACCTCAA |

TABLE 1-continued

Weed species and PDS gene sequences

| SEQ ID NO | SPECIES | TYPE | LENGTH | SEQ |
|---|---|---|---|---|
| | | | | TGCCTAAACCTTTACAAACACACATCATATAAGAAT<br>GAGTGTTAAAATTTACCTCTTCATCTCAGTAAAGTG<br>TCTCATTTACTTTTGCACAAATTTAAGGAACGTGTA<br>AGTTAGAGGATACAAATTAAAGTTAGGGAATCTTG<br>TAGGGCTCATAAAAAATGACAATCACCAA |
| 13 | Amaranthus palmeri | Genomic | 367 | TGGGTTTTAATATTAATCCAGGGAGAGGGTCTGGG<br>TCGTCCATTTATTGTTTTGGGACACGACATTGGACC<br>AGATCCGTTGAGTCTCAAAACATTGGACTCATAGC<br>CTAAAAATAGGTGTAGGGATAGGACATATCCAATA<br>AAGTCTTGGACCCATAAGCGTACATCCCTAATATGT<br>AGTACTAGAATATTTTATATGTTAAACATTAAATGC<br>ATGACTTCTGATTCCTCGGGTCTAGTAATAGAGTAT<br>TCTTAGGGCTCGCCTGAATTGTGTATAAATATTTAA<br>GAGGTAAATAAAAGTTAAAGTAGGAAGATAAAGT<br>TAATTAAATAGAAGATTAAAGGCATTAAATTGTCGT<br>CATCATCATCAT |
| 14 | Amaranthus palmeri | Genomic | 221 | AGCTTGGTATAAATGAGCGATTACAATGAAAGGAG<br>CACTCTATGATTTTTGCTATGCCAAGCAATCCTGGT<br>ATTTTCAGTCTTTTTTTTATTGAAGTCCTCCCAGGCT<br>CCAACAACATTTAACGTTTAGTTTGGTAATAAAATT<br>CGCAAAATGTCTGTATTTAGCGAAAGTCAAACTACT<br>CCTAATGACTTTCACGAGTCTCTTCATCAAGATGTT<br>TGGTG |
| 15 | Amaranthus palmeri | Genomic | 133 | TGACTCTCCATTTGATCTAAATAGAATTTCAACTCTT<br>TTGTAGTTGACGAAGTCCAAATTAGTTGGAGTGTG<br>TATATTGAAATGCATGAACTCTTATGCTACTATTTAT<br>ATACTTTTTCCGTTTCATAATACT |
| 16 | Amaranthus rudis | cDNA | 2132 | GCCTTTTGAATGTACATATTCTATTCTTGTAATCATT<br>TGATCAGCCAACATTAAGACCGTTTTCAATGAGAAC<br>TTCCTTCCGCAATACACAAAAAGATCCTCAAGACTA<br>GGCCCTAATAAATCAATCACGAGAATATTATCTTCC<br>CCATCCACTCCAGACCATTTCACAGTTGGAATCCCA<br>CTTCCTCCTTGAAGAATGGTGTATACCTTCGCCTCA<br>TACAGTAATTGCGGATGCTTCGTCTTGGTATTCTCG<br>AGCTTTACAGCGACAATCTCGAAGGTGTCGATATG<br>AGTAGCAAGGAAAATTTCACCGAAGGAACCACTGC<br>CGATCTTGCGACCTAGCTTGTACTTGCCTCCGACGA<br>TCCGATCCATAACGATTTCGATAAATTAAACAACCA<br>AAACTACCACCGTTGAAATTGATTGATATGGTGAA<br>ATCAATAGCGTGAAATTGAAAACATAAGTTAGGAT<br>TTTGGATAGATAAAGGGGAAAGTAGGTGCCGATG<br>AAGGGAAGAGAGAGAAAACTCAAGCTAAAAGCGG<br>GTAAGCAGACATCCAGAGAGAGAAAGAGAAAGAC<br>GATGAGTGTATGAGGTGGAGTTTTGGGGATTTTTA<br>ATTAGGGAAAGGGAAGGAAGGTGGAAATGGGAG<br>GAATTCTTTGGGGCTTATCCAAATATCCAAAATCTA<br>TTTGGAGAACTTGGTATAAATGATCGATTGCAATG<br>GAAGGAGCACTCTATGATTTTTGCAATGCCTAGCA<br>AGCCTGGTGAATTCAGTCGCTTTGATTTTCCCGAAG<br>TCCTGCCTGCACCATTAAATGGCATATGGGCAATCC<br>TAAGGAATAATGAAATGCTAACCTGGCCAGAAAAA<br>ATCAAGTTTGCCATTGGCTTGTTGCCTGCTATGGCT<br>GGCGGACAGTCATATGTTGAAGCACAAGACGGTTT<br>GAGTGTCCAAGAGTGGATGAGAAAACAAGGAGTA<br>CCCGATCGTGTAACTGATGAAGTATTTATTGCCATG<br>TCAAAGGCACTGAACTTCATAAATCCCGATGAACTT<br>TCAATGCAGTGCATCTTGATTGCTCTGAACCGATTC<br>CTGCAGGAGAAACATGGTTCTAAGATGGCCTTCCT<br>AGACGGAAACCCTCCAGAGAGGCTGTGCATGCCTA<br>TTGTTGAGCACATTGAGTCACTAGGTGGTGAAGTT<br>AAACTTAACTCTCGTATACAAAAGATTCAGTTGGAT<br>CAGAGTGGAAGCGTAAGAGTTTTTTGCTAACTAAT<br>GGGAGGGAAATAAGAGGAGATGCCTATGTATTTG<br>CTACCCCAGTTGACATTTTGAAGCTGTTGCTACCCG<br>ATACTTGGAAGGAAATCTCATACTTCAAAAAGCTTG<br>AGAAATTAGTGGGCGTTCCTGTGATTAATGTTCAC<br>ATATGGTTTGACAGAAAATTAAAGAATACGTATGA<br>CCATCTACTCTTCAGCAGGAGTCCTCTTTTGAGTGT<br>CTATGCTGATATGTCAGAGACATGCAAAGAATATA<br>AGGATCCAAATAGATCCATGCTGGAATTGGTTTTC<br>GCACCCGCGGAGGAATGGATTTCACGAAGCGACA |

TABLE 1-continued

Weed species and PDS gene sequences

| SEQ ID NO | SPECIES | TYPE | LENGTH | SEQ |
|---|---|---|---|---|
| | | | | CTGATATTATTGAGGCAACAATGCAAGAGCTCGCC AAGCTTTTCCCAGATGAAATCGCTGCTGATGGGAG CAAGGCCAAGATCCTTAAATATCATGTCGTCAAAAC TCCAAGGTCGGTTTATAAGACAGTACCGGATTGTG AGCCTTGTCGGCCGCTGCAAAGATCACCGATAGAG GGTTTCTATTTAGCTGGTGATTACACAAAACAAAAA TATTTGGCTTCTATGGAAGGTGCTGTCTTATCTGGG AAGCTTTGTGCTCAGGCTATTGTACAGGATTATGAT CTGCTGAGTTCTCGAGCACAAAGAGAATTGGCGGC GACAAGCAATGTATAACCCTGGATTGCTTTGACATC CGCCATTGATTTTCATTCGAGATCTGGATTGGGAAT CTGATCAGTCATCGAAAAATGATCAGCTGTAAACA AAATTATGGGGGTTGCACATTGGTGTTCTCAAGTTC TTGATTTATAAATTCTTCAGAAAGAAGATTTATTTG TAATGATATATCAATTGATTGAAATATGTATAGCTT ACTTCTAGGGAATTATGTATGTGCACCAGTTAACTT GATTGAAAT |
| 17 | Amaranthus rudis | cDNA | 2088 | TCCATTTTCTTGTTCTTTCAGTTTCACATACCCTCTC ATCAATCAATATCCAAAACTATTACATTTTCCAAACT ATTTCAAACCCAAAAATCAAAAACTTTTGATTGAAG AACAAACTTTGGGGGTTTTGGAAAATGAGTCATTT TGGATATGCTTGTGCTACTCAATCCACATCAAGATA TGTTCTTTTAGGAAATTCAAATAACCCCACTTCAATT TCATCTATTGGAAGTGATTTTTTGGGTCATTCTGTG AGAAATTTCAGTGTTAGTAAAGTTTATGGGGGAAA GCAAAGAAATGGGCACTGCCCTTTAAAGGTTGTTT GTATAGATTATCCTAGGCCAGAGCTTGAAAGTACA TCCAATTTCTTGGAAGCCGCCTACTTATCTTCTACTT TTCGGAATTCGCCTCGTCCTCAGAAGCCATTAGAA GTTGTAATTGCCGGAGCAGGTTTGGCTGGTCTATC CACGGCAAAGTATTTAGCTGATGCAGGTCACAAAC CCATATTGCTGGAAGCACGAGATGTTTTAGGAGGA AAGGTTGCAGCGTGGAAGGATGAGGATGGTGACT GGTACGAGACTGGGCTACATATATTCTTTGGGGCT TATCCAAATATCCAAAATCTATTTGGAGAACTTGGT ATAAATGATCGATTGCAATGGAAGGAGCACTCTAT GATTTTTGCAATGCCTAGCAAGCCTGGTGAATTCA GTCGCTTTGATTTTCCCGAAGTCCTGCCTGCACCAT TAAATGGCATATGGGCAATCCTAAGGAATAATGAA ATGCTAACCTGGCCAGAAAAAATCAAGTTTGCCATT GGCTTGTTGCCTGCTATGGCTGGCGGACAGTCATA TGTTGAAGCACAAGACGGTTTGAGTGTCCAAGAGT GGATGAGAAAACAAGGAGTACCCGATCGTGTAACT GATGAAGTATTTATTGCCATGTCAAAGGCACTGAA CTTCATAAATCCCGATGAACTTTCAATGCAGTGCAT CTTGATTGCTCTGAACCGATTCCTGCAGGAGAAAC ATGGTTCTAAGATGGCCTTCCTAGACGGAAACCCT CCAGAGAGGCTGTGCATGCCTATTGTTGAGCACAT TGAGTCACTAGGTGGTGAAGTTAAACTTAACTCTC GTATACAAAAGATTCAGTTGGATCAGAGTGGAAGC GTAAGAGTTTTTTGCTAACTAATGGGAGGGAAATA AGAGGAGATGCCTATGTATTTGCTACCCCAGTTGA CATTTTGAAGCTGTTGCTACCCGATACTTGGAAGG AAATCTCATACTTCAAAAAGCTTGAGAAATTAGTG GGCGTTCCTGTGATTAATGTTCACATATGGTTTGAC AGAAAATTAAAGAATACGTATGACCATCTACTCTTC AGCAGGAGTCCTCTTTTGAGTGTCTATGCTGATATG TCAGAGACATGCAAAGAATATAAGGATCCAAATAG ATCCATGCTGGAATTGGTTTTCGCACCCGCGGAGG AATGGATTTCACGAAGCGACACTGATATTATTGAG GCAACAATGCAAGAGCTCGCCAAGCTTTTCCCAGA TGAAATCGCTGCTGATGGGAGCAAGGCCAAGATCC TTAAATATCATGTCGTCAAAACTCCAAGGTCGGTTT ATAAGACAGTACCGGATTGTGAGCCTTGTCGGCCG CTGCAAAGATCACCGATAGAGGGTTTCTATTTAGCT GGTGATTACACAAAACAAAAATATTTGGCTTCTATG GAAGGTGCTGTCTTATCTGGGAAGCTTTGTGCTCA GGCTATTGTACAGGATTATGATCTGCTGAGTTCTCG AGCACAAAGAGAATTGGCGGCGACAAGCAATGTA TAACCCTGGATTGCTTTGACATCCGCCATTGATTTT CATTCGAGATCTGGATTGGGAATCTGATCAGTCAT CGAAAAATGATCAGCTGTAAACAAAATTATGGGGG TTGCACATTGGTGTTCTCAAGTTCTTGATTTATAAAT TCTTCAGAAAGAAGATTTATTTGTAATGATATATCA |

TABLE 1-continued

Weed species and PDS gene sequences

| SEQ ID NO | SPECIES | TYPE | LENGTH | SEQ |
|---|---|---|---|---|
| | | | | ATTGATTGAAATATGTATAGCTTACTTCTAGGGAAT TATGTATGTGCACCAGTTAACTTGATTGAAAT |
| 18 | Amaranthus rudis | Genomic | 4346 | AAGTATGTACAAGTTGTTAGGTCATCACTCAAAAG TGATGTGTCACATTTCATCATATGAGCAAAAAGTAT TTGGTTTTAGGGATAAGCGACTAAACAAATAGATC TATGTGAAGATTAACATTTTGGAATATTGAAACTCT ATTTGGGAAGTGATTGGAGTTGGTAGATAGAATG GAAAAACTTAAGATGGACTTTATGTAGGAGATCAC GTGGATTAATGGAGAGACCAGGCCATTCAAACAA ATAAGAAATTATGCACATTATTGTATACATGCAAAT TAAGAAGAGAAACAAACTTGGTATCATGATGGGTG AGTAGTTTGCCTATGACGTTGTAGAGGTGTGTGGA TAAATGATTAGAACATGAGCTATGAATGGAAGAGA AATATTAATGGTTGGTGCATATGCGCCTCAAGTGA AGGCAAAGGAAGCAACACCAACAATGTCAAAGTCT TATTTTTAGGTAATATGAAAAACAAAGGAAGCAAT CAAAAGAAATTTCTCAGGCGAGTTGATGCAAATTA TCCCAACATTAAGAAAATTTTGTATACTAGCGAACA TGTAGCCATCCATCACAAACACGTAGTCCTAGATCT TCATATGTGATCAACCTCGTGCAAGAATGAACTTCA AGGACAAAGAAAAATCAAATGATAGAACCCAAAT AAGAGGATACGAATTTTTCATTTGATTAGACAAAT GAGGAAGATCCAAATCCAACTTGGACAAAGATGAA GAATGTTATCACCCGCACAACTAGGGGAATTCAAG GTTAAGCGGATTGTGGTATGAGGTAAGAAAGAAT ACAATATAGGGGAATTAGGAAGTAAAGGAATAAG AAAAAAAAGAATGATATATAGCTTTAGGAAAATCT AGGAGTGAGGAGAATATAGCAAAATATGAGGAAG TTAAAACCAAGACGAAGCAAGCGATATGTGAGACA AAGTTAAAAGATAAGAGATATACAATAAGCTGACT CAAGAGAAGAGGATAATGATCTTTGTAGGGTAGCC TAAAGGAGACAAATGATTATAAAAGATACTAGTTG AATGAACTATGAAGTGTGTCTTGGATAAATAACAA AATAATATTCTCCAAGATGAATAGATATACGATAAA TGGAAGGAGTTTTTGACGAGTTGTGCAATGGATGT CAAGGGGCACGATAGTATACATCTAGAAGAAATTC TGAAAAGGTGCTTTTCTTAGAATGTAAATTGTGAG AAAAAGGAAGAAGGCGATTATCAGTAAATCAATTG TCTTTGTTCACAGAATGTGACACCAACATGTTGGAT GGGGGAGAGAAGTTTTCTTTGTTAACGAATCTTTC GGTTATGTATGGAAGTATGTTATTTTATGAGACATC TTGTTCAAGAGCTCATCATTAATATAGAGGAGTAG AGGTGTTCAACGGGATGGGTCGGGGCAAAATTTA AATTGGTCGGGCCGGGGCGGGTCATGTCTAAGAG GAGCAACAACATAAATAATAAAATATACCATCGTA TGGACATATAGTTTAGAGATAGATTCAAAATTTTT ATATCTTCAAATATGAATGTGAGAACCGACTTCTCA TACTTTATTTTACTTACAGGTTTGGCTGGTCTATCCA CAGCAAAGTATTTAGCTGATGCAGGTCACAAACCC ATATTGCTGGAAGCACGAGATGTTTTAGGAGGAAA GGTGTGTGCTATACTTTTCTTGTAGCTTATGAAACA ACTCCATTGTGCTTACTCTCTAATTAGTTTACTTCAG ACTATCAGATGATTTTTGAACTTTTTCCTCCCTCTGT TCGGCTGTATAATTATATATGAGAAACATGTTTAAA AATGGGTGCATTAACATATATGAAGTTTTTTTTATC AAGGCGAGATTTTGTCATCCAAAAACTTTACTTCTG AATCTGAACATGCTGTATGATCCTGTTTCTTTATCTT CATTTGTTGGGATTTTCTTGAGGCTCATGACTACTT TCAGTTATTATAGTTACCCATCCTGCATAAATCCGA GTTTACAGTTATAGTAATGAAAATAAATAGGCTAAT TATATTCTCGTCGGTCATCACAGTATGATGAATCTT GGGCTAATATGAAGATGAGGTAGGAAGAAGAATT TGTGTTAGTATGATAATATGCCCGCCCTAAGCAA GTGCAAGCCTTGCCTACGCCTAGGGCCCCCCAAAA ATTTTAGTTTTCAACTAGTGCTAACGTTCGAACTTTT CTATATATATACAATAGTTTAGGGGCCCAAATAATC TTTCGCCCCGGGCCCTAAAAACCTAGGGTCGGCT AGTGCCAAGAGAAATATTGTTGTGCAAAGTTTCTT GGTATTTTTCTTGTGCTTACAATTCTTGCTCCACAG ATTGCAGCGTGGAAGGATGAGGATGGTGACTGGT ATGAGACTGGGCTACATATATTCTGTGAGTGATCTT TTAATTTTCTGCTTAGTTGGGTAGTTACCCGTGTAC TTATTATGTGCACTCTAGTCATGTTTATTGGAAAAA TTTACTGCATATTTATCAGTCCGATGTACTGAACAT |

TABLE 1-continued

Weed species and PDS gene sequences

| SEQ ID NO | SPECIES | TYPE | LENGTH | SEQ |
|---|---|---|---|---|
| | | | | CTTCATATTTTCTTGAAGTTGGGGCATATCCAAATA TCCAAAATCTATTTGGAGAACTTGGTATAAATGACC GATTGCAATGGAAGGAGCACTCTATGATTTTTGCA ATGCCTAGCAAACCCGGTGAATTCAGTCGCTTTGAT TTTCCCGAAGTCCTGCCTGCACCATTAAATGGTTAG TATATCGGTGATGGTTTTTGTTGGCTGCCAAATTAC TTGATGCAATGCATTACCTTGTAAAATACTCCTTCC GTCCCCCTGATTTTGCCCCATATACTATTTTAGTCCG TTCAATTGAATTTGCCCATTATTATTTTTGGACGTG GTTCCACCTATAATACTTGCTATAACCTACAATTTAT TTCTCTTTCCTACATCAAAAACTATGATTATCCCGCT AAAGGACATGGCCCCACTTACAACACCTCACTAAA ATACCCACTCACCCGCTTTTCTTAATCATTGTACCAT CCGCCCGAGGAGCAATCTCGGGGGGACAGCGGAG TACTACTTTAGTGTTTATGTGATGAAATAGGTACCT GCATCAATATCTCATGTCCTGTGGATACCTAGAAAT GAATGAAAATTATCATTCCGTATTATCCTGCTTTAG AAGCTTGTAATATCACTGAACTTTGTTATTCTAATG TCTTAACATGAAAAGAATCTGCATCTTGGTCTGTTT GGACTTTGGTACTCCTAAACCCTAACGAGTCGGGC TGATTTATATCTTTGATGCTTTTTGATTGTGTTTGGC AGGCATATGGGCAATCCTAAGGAATAATGAAATGC TAACCTGGCCAGAAAAAATCAAGTTTGCCATTGGC TTGTTGCCTGCTATGGCTGGTGGACAGTCATATGTT GAAGCACAAGATGGTTTGAGTGTCCAAGAGTGGA TGAGAAAGCAAGTAGGAGCAGACTTTCGTTTCAGA TTTTCCTCATTTTGTTAATCTCTTCTGATTCTGTCGAT TACGATGATTCTAGCTGTAAACTTTGACTTTGTTGG GACTTCAATGCTGAAATTCTGTTTGCGCATAAATGC AGGGAGTACCTGATCGTGTAACTGATGAAGTATTT ATTGCCATGTCAAAGGCACTGAACTTCATAAATCCC GATGAACTTTCAATGCAGTGCATCTTGATTGCTCTG AACCGATTCCTGCAGGCATGAGTGCCTTTCAATTTC TGCTTTAAATTTTTTGTTTTGTACGACACTTCTTATT GCTTGTTTTTGTGACTATTCTCGAGTAAATTTGGGA TATAAAATGACCGTGCTGTTTTCCATAAACTGACCT TGGGTAATGTATATCAACAGGAGAAACATGGTTCT AAGATGGCCTTCCTTGACGGAAACCCTCCAGAGAG GCTGTGCATGCCTATTGTTGAGCACATTGAGTCACT AGGTGGTGAAGTTAAACTTAACTCTCGTATACAAA AGATTGAGTTGGATCAGAGTGGAAGTGTTAAGAG TTTTTTGCTAACTAATGGGAGGGAAATAAGAGGAG ATGCCTATGTATTTGCCACCCCAGGTTTTCTTCTCTC CCTTTTTTGCCATAAGGTCTCTATCAAACTCCGTAA AAGCTACATAGTAAAGAAAATGAAGATTCCATTGC AGATATGGACACACCGTATAGCTTAACTAGTTTTGA TCTTGTGCAAAGCACTTGTGTTTCCAAATTTGTTAA TGGGTTATAATTTAAATAGAATACTTATGTTTGTAA TGTCAAGCGTTGAGCCAAAGTGTTATAACAATGAT TATATAGTGTAGATCATCGTGTAAAATTGCGGTAA ATTTTGGT |
| 19 | Amaranthus rudis | Genomic | 3438 | CTCAAAATTGTTGAAAAATAGCCCAAGACCGACCA TAATTCTTTTTTTTTGATTTGCGATTCGCAGGGAG ATTAGCGAATCATGTGACACTGTGTCTGATATAATT TTTGAATTTCATTGTCAGTTGACATCTTGAAGCTGT TACTACCTGATACTTGGAAGGAAATCTCATACTTCA AAAAGCTTGAGAAATTAGTGGGCGTTCCTGTGATT AATGTTCACATATGGTTAGTTGATTCTTCATTCTATA TTAAATATACTCGTTAGATTTTATACCCATTTTCCGT CTCAGGAAAAATACTATTCGCTGCAATAGAGAACG ATAAAATGTGGATTATTTAATGCGTTGCTTTACTCC GGGGCTAATGGTATAATAACGCTTCATGCAGGTTT GACAGAAAATTAAAGAATACATATGACCATCTACT CTTCAGCAGGTTGTATTTCGTTTCTTTTATCATCCTA TTTCTCTTTCGTAACTCTCAAATAATCTCGTTCCTCC CCTTCCCTCCTTCACTTCAACACTTGTTTCAATTCTTC ATTTTCGGCCGTAGTCAAATTTGATGAACATTTGAC AAGAGTTGCATTATAACTAATATGAACATTGGAGA AGGAGCAACAATCATCATCTATGAAGTATAAGCTA AGATTCCTTTGAAGAAGGTGAAAGTTAAGTGCGAA TTTTCTTTCCATTGGGAAATAAGTCTTTTGATTAACG TCTTGAATAGATGAAGGATGCAAGTTTTTGGAATG AAGAGAAACTTTTTATGTGATCTAGTTGCGAGTCG ATGGTGCCTTGAATTTCTTCAAAATTAAACATTTTT |

TABLE 1-continued

Weed species and PDS gene sequences

| SEQ ID NO | SPECIES | TYPE | LENGTH | SEQ |
|---|---|---|---|---|
| | | | | GTTAATGTTCGCTTTATTGTTGCGCTTTCATGTCCTT<br>TTCCTATAGTTGTATATGGCTTCTCATTCTCAACTTA<br>GGCTTACCTCAATGCCTAAACCTTTACAAAACACAT<br>CATATAAGAATGAGAGTGTTGAATTGTTGATATTTA<br>CCTCTCCATCTCAGCACAAGTTTCCTTTACTTTTGCA<br>CAAATCTTAGGAATGTGTAAGTTGGTGAATAGAAA<br>TTACTGTTAGGGAATCTTGTGGGGCTCAAACAAAT<br>GAGAACCGCAAATAACTTTCTAAATATAGAAATGG<br>GTCACTCGTGGTGAAAAGATCCAATATGAAAATTA<br>GACACTTGTGCTGAGATGGAGGAAGTATCATACTT<br>GTAAAAACATAATACTTGAGGCTGATGTGACTTTG<br>GTAGTAACTAGTAACCATAGTGCAAAAATGCGGTA<br>ACCGGTTGCAATCACGGTAACGACACGATGATGCG<br>GTTATCATAACGCCAAATATCGGCCAAAAGCGTGA<br>GATATTCCTTCTAACAACCCAAAAACGCAGTTTTTT<br>TACACCTTTATATCGCAAGAAATATATGTTCGTTTTT<br>TGAAAATCTTTAGAACGCGGCCGTTGCGATGTGAT<br>GCTATGCGGCCTTATTTTTTCACTATGGTAATGACA<br>AAACATTTGCGGATGCACACATTGGCTACCGTTTCT<br>GATCCCCTTTTCATTTGTACACATCAATGTAACGTA<br>ATTCCCCAGCTAATTCGCCTTTTGAATTCGGAATTCT<br>CTCAAAATTGTGGAAAAATAGCCCAACTCCTACCAT<br>AATTCGCTTTTTTCGATTTGCAATTCGCGGGGAGAT<br>TAGCGGATCACATGACAATGATACAAATCCTATGG<br>ATTTATGTATGTTACTGATTTAAAGACTTCAACCCCT<br>TAGATTAAATGTTGAAACCATATAAGAATGGAATTT<br>TTAAGATTTTTTTATCTAAATTCTTTCCTGAACCCT<br>ATTATTAAGTAGCTATGGCCTACTAGAGGTGGTTA<br>CGATTCATCATCCTTTTCATCGGCTTCATGAATTTGT<br>ACATATCTTGGACTTCTCCAGTTCTCCTTTAATTTTG<br>TTTATCTTTGTTATTTCAGGAGTCCTCTTTTGAGTGT<br>CTATGCTGATATGTCGGAGACATGCAAGGTGAGCA<br>TATTCCCATTTTTTTATTTCCGACTTATATGTTCGTG<br>TTCTCCGTTTGTCTCTTTTTCGCGCATATAATATCGA<br>ATGTTAGCCACTCCCCGTTACTCCTTCTATTCTGCTA<br>ACACCGGGATTTTAACTATGAGGGTCCTCAGAATT<br>AATTATAAAAATTCGACAAAAACAAAAAAAAGAAA<br>TAAAATTGATGGGTCATAACAATTTTACTTGAGATA<br>TTCAACATTTATTTTACAATTTTTCTTAAGAAATTCA<br>GTACATCTACACTCCCGAGCCACTGCATGTGAGCG<br>CCGCGGCTTGCTGTTTAAGAAACCTTTCTTAGAAGT<br>GTCGACTATATGCAGTTTCTTCCATTCTTACGATCAT<br>TTACAGGAATATAAGGATCCAAATAGATCCATGCT<br>GGAATTGGTTTTCGCACCCGCGGAGGAATGGATTT<br>CACGAAGCGACACCGATATTATCGAGGCAACAATG<br>AAAGAGCTTGCCAAGCTTTTCCCGGATGAAATCGC<br>TGCCGATGGGAGCAAGGCCAAGATCCTTAAATATC<br>ATGTCGTCAAAACTCCAAGGTGATCGATAAACTTG<br>TGAAATTAAAATTGGATAATATCATGCTACCGCTAG<br>AAACAGCATTAATGTTGTGCCCGCGGGCTCTTTTAT<br>AGGTCGGTTTATAAGACAGTGCCGGATTGTGAACC<br>TTGTCGGCCGCTGCAAAGATCACCGATAGAGGGTT<br>TCTATTTAGCTGGTGATTACACAAAACAAAAATATT<br>TGGCTTCAATGGAAGGTGCTGTTTTATCTGGGAAG<br>CTTTGTGCTCAGGCTATTGTACAGGTAATCAAAGTT<br>TGATTAAACACCGCGGGCATGCTGATTAGACTTTTC<br>GTATTTTGATTCGATCCGAAATTGACCCAAAACCGA<br>CCGGAAATCGGTGGGTTATAATTTAGAAAATATGA<br>CCCGTAACCAAAAAATGACTCAAACCCACCGTAGC<br>CCAAATCCAATCGTTTTGACTTGTTTACCTAATTTTG<br>TCAACTTTTCTTGTTCCACGTCGTTAGTTTTCTGTCG<br>GGAGTCGGGACCCACTATCTTTCTAGTCTGTTTTTG<br>TATTTCTTTTTTCTTTGTTGATGCTTTTATTCGTTTTT<br>ACCTAGTTATGTTTATATATTTATGTGTTTTATTTAT<br>TTATATGTTTTTGACTACCGAGGTATGATGATTGTT<br>TCTATGAGCGGATATACTGAGTATGATGATGATGA<br>TTTATTCTTTTTTATAAAAAAAAAGTTAAAGGTCTTT<br>TTTTGAAAATATTTTAGTGATTTTTTTGACCTGATCA<br>AATTTCAATTCGAACCAAAAATAACCCAAGCGAAA<br>GTGACTCAACCCGAAACCTACCCTGATCTAATTGTA<br>ATGATAGCTTTGAAATTTTTATCGTTTTAGTTAACA<br>AGTTCTGTTGACGAATCTTCTTTAAATTTTTACAAGT<br>TAATATAAATCTCGAAAGTTCCTATA |

TABLE 1-continued

Weed species and PDS gene sequences

| SEQ ID NO | SPECIES | TYPE | LENGTH | SEQ |
|---|---|---|---|---|
| 20 | Amaranthus rudis | Genomic | 2037 | CAGGGAGATTAGCGAATCATGTGACACTGTGTCTG ATATAATTTTTGAATTTCATTGTCAGTTGACATCTTG AAGCTGTTACTACCTGATACTTGGAAGGAAATCTC ATACTTCAAAAAGCTTGAGAAATTAGTGGGCGTTC CTGTGATTAATGTTCACATATGGTTAGTTGATTCTT CATTCTATATTAAATATACTCGTTAGATTTTATACCC ATTTTCCGTCTCAGGAAAAATACTATTCGCTGCAAT AGAGAACGATAAAATGTGGATTATTTAATGCGTTG CTTTACTCCGGGGCTAATGGTATAATAACGCTTCAT GCAGGTTTGACAGAAAATTAAAGAATACATATGAC CATCTACTCTTCAGCAGGTTGTATTTCGTTTCTTTTA TCATCCTATTTCTCTTTCGTAACTCTCAAATAATCTC GTTCCTCCCCTTCCCTCCTTCACTTCAACACTTGTTTC AATTCTTCATTTTCGGCCGTAGTCAAATTTGATGAA CATTTGACAAGAGTTGCATTATAACTAATATGAACA TTGGAGAAGGAGCAACAATCATCATCTATGAAGTA TAAGCTAAGATTCCTTTGAAGAAGGTGAAAGTTAA GTGCGAATTTTCTTTCCATTGGGAAATAAGTCTTTT GATTAACGTCTTGAATAGATGAAGGATGCAAGTTT TTGGAATGAAGAGAAACTTTTTATGTGATCTAGTTG CGAGTCGATGGTGCCTTGAATTTCTTCAAAATTAAA CATTTTTGTTAACGTTCGCTTTATTGTTGCGCTTTCA TGTCCTTTTCCTATAGTTGTATATGGCTTCTCATTCT CAACTTAGGCTTACCTCAATGCCTAAACCTTTACAA AACACATCATATAAGAATGAGAGTGTTGAATTGTT GATATTTACCTCTCCATCTCAGCACAAGTGTCTCCTT TACTTTTGCACTAAATTTTAGGAACATGTAAGTTAA TGGATAGAAATTAAAGTTAGGGAATCTTGTAGGGC TCAAACAAATGAGAACTGCAAATAACTTTCTAAATA TAGAAATGGGTCACTTGTGGTGACTTGATCCTATAT GAAAATCTGACACTTGTGCTGAGATGGAGCAAGTA TTATACTTATGAAAACATAATACTTGAGGTAGATAT ACCTTTGGTAGGAACTAGGAACCATAGTGCAAAAA TGTGGTAACGGTTGCAATCGTGGTCACGACATGCG ATTATCATAACGCCTAATATGAGCCAAAAGCGTGA GATATTCCTTGTAACGGCCCAAAACACGGTTTTTTT TACACCTTTACATCGCGAGAAATTTCGGTTTGTTTTT TTAGAATCTTTAAAATACGGCCGATGCTATGCGAT GCGATGCGGCCTTATTTTGCACTATGGTAGGGAC AAAACATTTGCGGATGATGGATGCACACATTGGTT ACCATGTCTGGTCCCCTTTTCACTTATACAGATCCCA AGGGCATATGTATGTTACTGATTCAAAGACTTCAAT CTCTAGGATTAAATGTAGAAACCATATAAAAATGG ATCTTTAAAATACTTTTATCTTTGTTATTTCAGGAGT CCTCTTTTGAGTGTCTATGCTGATATGTCGGAGACA TGCAAGGTGATCATATTCCCATTCTTTTATTTCCGAC TTATATGTTCTAGTTCTCCATTTGTCTCTTTTTCGCG CATATAATTTCGAATGTTAGCCACTCCCCATTACTCC TTCTATTTCTGCTAACACCGGGATTTTAACTATGAG GGTCCTCAGAATTGATTATAAAAATTCGACAAAAA CAAAAAAAAAGAAATAAAATTGATGGGGGCCATA ACAATTTTACTCAAGATATTCAACATTTATTTTACAA TTTTTCTTAAGAAATTCAGTACATCTACACTCCCGA GCCACTGCATATGTGCGCCACGGCTTGCTGTTTAA GAAACCTTTCTTAGAAGTGTCGACTATATGCAGTTT GTTCCATTCTTACGATCATTTACAGGAATATAAGGA TCCCAATAGATCCATGCTGGAATTGGT |
| 21 | Amaranthus rudis | Genomic | 1502 | TGAATGTGAGAACCGACTTCTCATACTTTATTTTAC TTACAGGTTTGGCTGGTCTATCCACAGCAAAGTATT TAGCTGATGCAGGTCACAAACCCATATTGCTGGAA GCACGAGATGTTTAGGAGGAAAGGTGTGTGCTAT ACTTTTCTTGTAGCTTATGAAACAACTCCATTGTGCT TACTCTCTAATTAGTTTACTTCAGACTATCAGATGAT TTTTGAACTTTTTCCTCCCTCTGTTCGGCTGTATAAT TATATATGAGAAACATGTTTAAAAATGGGTGCATT AACATATATGAAGTTTTTTTATCAAGGCGAGATTT TGTCATCCAAAAACTTTACTTCTGAACATGCTGTCT GATCCTGTTTCTTTATCTTCATTTGTTGGGATTTTCT TGAGGTTCATGACTACTTTCAGTTATTATAGTTACC CATCCTGCATAAATCTGAGTTTACAGTTATAGTAAT GAAAATAAATAGGCTAATTATATTCTCGTCGGTCAT CACAGTATGATGAATCTTGGGCTAATATGAAGATG AGGTAGGAAGAAGAATTTGTGTTAGTATGATAATA |

TABLE 1-continued

Weed species and PDS gene sequences

| SEQ ID NO | SPECIES | TYPE | LENGTH | SEQ |
|---|---|---|---|---|
| | | | | TGTGCCCGCCCTAAGCAAGTGCAAGCCTTGCCTAC GCCTAGGGCCCCCCAAAAATTTTAGTTTTCAACTAG TGCTAACGTTCGAACTTTTCTATATATATACAATAG TTTAGGGGCCCAAATTAGTTTAGGGGCCCAAATAA TCTTAGGGGCCCAAATAATCTTTCGGGCCCAAATA ATCTTTCGCCCCGGGCCCCTAAAAACCTAGGGTCG GCTAGTGCCAAGAGAAATATTGTTGTGCAAAGTTT CTTGGTATTTTTTCTTGTGCTTACAATTCTTGCTCCA CAGATTGCAGCGTGGAAGGATGAGGATGGTGACT GGTATGAGACTGGGCTACATATATTCTGTGAGTGA TCTTTTAATTTTCTGCTTAGTTGGGTAGTTACCCGTG TACTTATTATGTGCACTCTAGTCATGTTTATTGGAA AAATTTACTGCATATTTATCAGTCCGATGTACTGAA CATCTTCATATTTTCTTGAAGTTGGGGCATATCCAA ATATCCAAATCTATTTGGAGAACTTGGTATAAATG ACCGATTGCAATGGAAGGAGCACTCTATGATTTTT GCAATGCCTAGCAAACCCGGTGAATTCAGTCGCTT TGATTTTCCCGAAGTCCTGCCTGCACCATTAAATGG TTAGTATATCGGTGATGGTTTTGTTGGCTGCCAAA TTACTTGATGCAATGCATTACCTTGTAAAATACTCC TTCCGTCCCCTGATTTTGCCCCATATACTATTTTAG TCCGTTCAATTGAATTTGCCCATTATTATTTTGGAC GTGATTCCACCTATAATACTTGCTATAACCTACAAT TTATTTCTCTTTCCTACATCAAAAACTATAATTATCC CGCTAAAGGACATGGCCCCACTTACAACACCTCACT AAAATACCCACTCACCCGCTTTTCTTAATCAT |
| 22 | Amaranthus rudis | Genomic | 680 | GATATTATCGAGGCAACAATGAAAGAGCTTGCCAA GCTTTTCCCGGATGAAATCGCTGCCGATGGGAGCA AGGCCAAGATCCTTAAATATCATGTCGTCAAAACTC CAAGGTGATCGATAAACTTGTGAAATTAAAATTGG ATAATTTCATGCTACCGCTAGAAACAGCATTAATGT TGTACCCGTGGGCTCTTTTATAGGTCTGTTTATAAG ACAGTGCCGGATTGTGAACCTTGTCGGCCGCTGCA AAGATCACCGATAGAGGGTTTCTATTTAGCTGGTG ATTACACAAAACAAAAATATTTGGCTTCAATGGAA GGTGCTGTTTTATCTGGGAAGCTTTGTGCTCAGGCT ATTGTACAGGTAATCAAAGTTTGATTAAACACCGC GGGCATGCTGATTAGACTTTTCGTATTTTGATTCGA TCCGAAATTGACCCAAAACCGACCGGAAATCGGTG GGTTATAATTTAGAAAATATGACCCGTAACCAAAA AATGACTCAAACCCACCGTAGCCCAAATCCAATCGT TTTGACTTGTTTACCTAATTTTGTCAACTTTTCTTGTT CCACGTCGTTAGTTTTCTGTCGGGAGTCGGGACCC ACTATCTTTCTAGTCTGTTTTTGTATTTCTTTTTTCTT TGTTGATGCTTTTATTCGTTTTTACCTAGTTATGTTTA |
| 23 | Amaranthus rudis | Genomic | 433 | AGTTCATATTTTGTATATATGCAGGATTATGATCTG CTGAGTTCTCGAGCACAAAGAGAATTGGCGGCGAC AAGCAATGTATAACCCTGGATTGCTTCGACATCCGC CATCGATTTTCATTCGGGATCATCTGATCGGTCATC GAATAATGATCAGCTGTAAACACAAAATTATGGGG GTTGCATACTGGTGTTCTTCAAGTTCTTAATGTATA AATTCTCCAGAAAGAAGATTTATTTGTAATGATATA TCAATTAAATTTATGTTGTGATAGAAATATGTATAG CTTACTTCTAGGGAAAATTATGTTTGTACACCAGTT AACTTGATTGAAATGTGAAGAAAGTATCAACTTTG TCACTTGATTTACTTGTAAGTATAACATAATATCAA TTTATACCAATACATTTATTTCCCTTTTCTGTTTAATT AT |
| 24 | Amaranthus rudis | Genomic | 210 | CAATTCGAACCAAAAATAACCCAAGCGAAAGTGAC TCAACCCGAAACCTACCCTGATCTAATTGTAATGAT AGCTTTGAAATTTTTATCGTTTTAGTTAACAAGTTCT GTTGACGAATCTTCTTTAAATTTTTACAAGTTAATAT AAATCTCGAAAGTTCCTATAAACTTATTTTACAGAT TGTCAAGATTAGTTGTATAAAAGTGAAGT |
| 25 | Amaranthus spinosus | cDNA | 951 | CAATCCTAAGGAATAATGAAATGCTAACCTGGCCA GAAAAAATCAAGTTTGCCATTGGCTTGTTGCCTGCT ATGGCGGCGGACAGTCATATGTTGAAGCACAAG ATGGTTTGAGTGTCCAAGAGTGGATGAGAAACAA GGAGTACCCGATCGTGTAACTGATGAAGTATTTAT TGCCATGTCAAAGGCACTGAACTTCATAAATCCCGA TGAACTTTCAATGCAGTGCATCTTGATTGCTCTGAA |

TABLE 1-continued

Weed species and PDS gene sequences

| SEQ ID NO | SPECIES | TYPE | LENGTH | SEQ |
|---|---|---|---|---|
| | | | | CCGATTCCTGCAGGAGAAACATGGTTCTAAGATGG |
| | | | | CCTTCCTAGACGGAAACCCTCCAGAGAGGCTGTGC |
| | | | | ATGCCTATTGTTAAGCACATTGAGTCACTAGGTGGT |
| | | | | GAAGTTAAACTTAATTCTCGTATACAAAAGATTCAG |
| | | | | TTGGATCAGAGTGGAAGCGTGAAGAGTTTTTTGCT |
| | | | | AAATAACGGGAGGGAAATACGAGGAGATGCCTAT |
| | | | | GTTTTTGCCACCCCAGTTGACATTTTGAAGCTGTTA |
| | | | | CTACCCGATACTTGGAAGGAAATCTCATACTTCAAA |
| | | | | AAGCTTGAGAAATTAGTGGGCGTTCCTGTGATTAA |
| | | | | TGTTCACATATGGTTTGACAGAAAATTAAAGAATAC |
| | | | | ATATGACCATCTACTCTTCAGCAGGAGTCCTCTTTT |
| | | | | GAGTGTCTATGCTGATATGTCGGAGACATGCAAGG |
| | | | | AATATAAGGATCCAAATAGATCCATGCTGGAACTG |
| | | | | GTTTTTGCACCCGCGGAGGAATGGATTTCTCGAAG |
| | | | | TGACACTGATATTATCGAGGCTACAATGACAGAGC |
| | | | | TTGCCAAGCTTTTCCCGGATGAAATCGCTGCCGATG |
| | | | | GAAGCAAGGCCAAGATCCTCAAATATCATGTCGTC |
| | | | | AAAACTCCAAGGTCGGTTTATAAGACTGTACCAGA |
| | | | | TTGTGAACCTTGTCGGCCGCTGCAAAGATCACCAA |
| | | | | TAGAGGGTTTCTATTTAGCTGGTGATTACTACA |
| 26 | Amaranthus spinosus | cDNA | 568 | GGATATGCTTGTGCCACTCAATCCACATCAAGATAT |
| | | | | GTTCTTTTAGGAAATTCAAATAACCCCACTTCAATTT |
| | | | | CATCTATTGGAAGTGACTTTTTGGGTCATTCTGTAA |
| | | | | GAAATTTCAGTGTTAGTAAAGTTTATGGGGGAAAG |
| | | | | CAAAGAAATGGGCATTGCCCTTTAAAGGTTGTTTG |
| | | | | TATAGATTATCCTAGGCCAGAGCTTGAAAGTACAT |
| | | | | CAAATTTCTTGGAAGCCGCCTACTTATCTTCTACTTT |
| | | | | TCGGAATTCGCCTCGTCCTCAGAAGCCATTAGAAG |
| | | | | TTGTAATTGCTGGAGCAGGTTTGGCTGGTCTATCCA |
| | | | | CGGCAAAGTATTTAGCTGATGCAGGTCACAAACCC |
| | | | | ATATTGTTGGAAGCACGAGATGTTTTAGGAGGAAA |
| | | | | GGTTGCAGCGTGGAAGGATGAGGATGGTGACTGG |
| | | | | TATGAGACTGGGCTACATATATTCTTTGGGGCATAT |
| | | | | CCAAATATCCAAAATCTATTTGGAGAACTTGGTATA |
| | | | | AATGACCGACTGCAATGGAAGGAGCACTCTATGAT |
| | | | | TTTTGCAATGCCTAGCAAGCCCGGTGAATTCAGTC |
| 27 | Amaranthus viridis | cDNA | 2070 | AAAACTTTTGATTGAAGAACAAACTTTGGGGTTTTG |
| | | | | GAAAATGAGTCATTTTGGATATGCTTGTGCTACTCA |
| | | | | ATCCACATCAAGATATGTTCTTTTGGGAAATTCAAA |
| | | | | TAACCCCACTTCAATTTCATCTATTGGAAGTGATTTT |
| | | | | TTGGGTCATTCTGTGAGAAATTTCAGTGTTAGTAAA |
| | | | | GTTTATGGGGCAAAGCAAAGAAATGGGCACTGCCC |
| | | | | TTTAAAGGTTGTTTGTATAGATTATCCTAGGCCTGA |
| | | | | GCTTGAAAGTACATCCAATTTCTTGGAAGCCGCCTA |
| | | | | CTTATCTTCTACTTTTCGGAATTCGCCTCGTCCTCAG |
| | | | | AAGCCATTAGAAGTTGTAATTGCTGGAGCAGGTTT |
| | | | | GGCTGGTCTATCCACGGCAAAGTATTTAGCTGATG |
| | | | | CAGGTCACAAACCCATATTGTTGGAAGCACGAGAT |
| | | | | GTTTTAGGAGGAAAGGTTGCAGCGTGGAAGGATG |
| | | | | AGGATGGTGACTGGTATGAGACTGGGCTACATATA |
| | | | | TTCTTTGGGGCATATCCAAATATCCAAAATCTATTT |
| | | | | GGAGAACTTGGTATAAATGACCGACTGCAATGGAA |
| | | | | GGAGCACTCTATGATTTTTGCAATGCCTAGCAAGCC |
| | | | | CGGTGAATTCAGTCGCTTTGATTTTCCAGAAATCCT |
| | | | | GCCTGCACCATTAAATGGCATATGGCAATCCTAA |
| | | | | GGAATAATGAAATGCTAACCTGGCCAGAAAAAATC |
| | | | | AAGTTTGCCATTGGCTTGTTGCCTGCTATGGCGGG |
| | | | | CGGACAGTCATATGTTGAAGCACAAGATGGTTTGA |
| | | | | GTGTCCAAGAGTGGATGAGAAAACAAGGAGTACC |
| | | | | TGATCGTGTAACTGATGAAGTGTTTATTGCCATGTC |
| | | | | AAAGGCACTGAACTTCATAAATCCCGATGAACTTTC |
| | | | | AATGCAGTGCATCTTGATTGCTCTGAACCGATTCCT |
| | | | | GCAGGAGAAACATGGTTCTAAGATGGCCTTCCTAG |
| | | | | ACGGAAACCCTCCAGAGAGGCTGTGCATGCCTATT |
| | | | | GTTAAGCACATTGAGTCACTAGGTGGTGAAGTTAA |
| | | | | ACTTAATTCTCGTATACAAAAGATTCAGTTGGATCA |
| | | | | GAGTGGAAGCGTGAAGAGTTTTTTGCTAAATAACG |
| | | | | GGAGGGAAATACGAGGAGATGCCTATGTTTTTGCC |
| | | | | ACCCCAGTTGACATTTTGAAGCTGTTACTACCCGAT |
| | | | | ACTTGGAAGGAAATCTCATACTTCAAAAGCTTGA |
| | | | | GAAATTAGTGGGCGTTCCTGTGATTAATGTTCACAT |
| | | | | ATGGTTTGACAGAAAATTAAAGAATACATATGACC |
| | | | | ATCTACTCTTCAGCAGGAGTCCTCTTTTGAGTGTCT |

TABLE 1-continued

Weed species and PDS gene sequences

| SEQ ID NO | SPECIES | TYPE | LENGTH | SEQ |
|---|---|---|---|---|
| | | | | ACGCTGATATGTCGGAGACATGCAAGGAATATAAG GATCCTAATAGATCCATGCTGGAACTGGTTTTTGCA CCCGCGGAGGAATGGATTTCACGAAGCGACACTGA TATTATCGAGGCAACAATGAAAGAGCTTGCCAAGC TTTTCCCGGATGAAATCGCTGCCGATGGAAGCAAG GCCAAGATCCTTAAGTATCATGTTGTGAAAACACCA AGGTCGGTTTATAAGACTGTACCGGATTGTGAACC TTGTCGGCCGCTGCAAAGATCACCAATAGAGGGTT TCTATTTAGCTGGTGATTACACAAAACAAAAATATT TGGCTTCTATGGAAGGTGCTGTCTTATCTGGGAAG CTTTGTGCACAGGCTATCGTACAGGATTATGATCTG CTGAGTTCTCGAGCACAAAGAGAATTGGCGGCGAC AAGCAATGTATAACCCTAAATTGCTTCGACATCCGC CATCGACTTTCATTCGAGATCTGGATTGGGAATCTG ATCATCGAATAATGATCAGCTGTAAAGAAAATTGT GGGGGTTGCATACTGGTGCTGTTCAAGTTCTTGAT GTACAAATTCTCCTGAAAGAAGATTTATTTGTAATG ATATATCAATTGATAGAAATATGTATAGCTTACTTC TAGGGAATTATGTATGTGCACCATTTGTAACTTGAT TGAAATGTAAGTATCAACTTGGTCTCTTGATTGAAA TGTAAGTATCAACATAATACAAATTTATACCAATAC ATTTATTTCCC |
| 28 | Ambrosia artemisiifolia | Genomic | 1388 | ATCCATACGCTCAGGTAATCTATCTTCACTTAATCCT TAGGGTTTATATTTCCTGCTTAAGAAGGTGAGTTTA TGTTACAATGCTTTGCTTTATTTTAACTTTATGTGTT CGATTTCATGTTAAATCTTCACATGTTAATTGATTA GGATTATTTTTATTCTTTTTTATTTGAATTAGCGTTA AAATCATTTATGGATTTTTTATTTGAACCATTTATTG TGTGGACTTCCATTTCTATAATTATCATTCAAATAGT AAGAAAAAGGAATGAAAAGTCTAGCTTTATTTTGA TATATATATTTTTTATCATTTCTGTAGGGCATACCAG ATCGAGTTACTACTGAGGTGTTTATTGCCATGTCAA AGGCATTAAACTTCATCAATCCAGATGAACTTTCAA TGCAGTGCATTCTCATTGCTCTCAACCGCTTTCTTCA GGTAAACTCATTTATTATACCTTGACGCTTATTGATT TAAGTATTTTGGAATAAACTAATATCACTACAATTT AGTTTCATTTATGTTTTCTGTATATAAAAGATGAGT CATAAATCATTATTGTTGTTGTCTAAAGACACTGCA ACTCCTGACTGTATTTTCAGTTATTGACTGGTATAA AATGAATCAACAGGAAAAGCATGGCTCTAAGATGG CATTTTTAGATGGCAGCCCACCTGAAAGACTTTGCA TGCCAATTGTTGACCATATTGAATCACTAGGTGGCC AAGTCAGACTTAATTCGCGGATACAAAAGATCGAG TTAAACAAAGATGGGACTGTTAAAAACTTTTTACTG AATGATGGGACTGTCATCAAAGGTGATGCTTATGT GTTTGCTACTCCAGGTATGTTAATTCAAACCACTAT TTGGCTTTGAACTTTGAAGTCTCCACATATATCTCTC TCTGGAGTGCACAAGCTTTATTGTCTGTTTTGTATC AAGCAGTTGACATTCTGAAGCTTCTTTTGCCTGAAG ATTGGAAACCGGTTCCATACTTCAAAAAGTTGGAA AAATTAGTTGGTGTTCCAGTTATAAACGTTCATATA TGGTTAGATGGACCCTTTCAATATAATGCTAATCCT TATAACGATAGTAGTTATGCCCTTTCACTTGTTTTAT TGTTACCCCAATTTTCTAGGTTTGTACTAGGAAGCT CAAAAACACTTATGATCACCTACTTTTCAGCAGGTC ACCTCTTATTTCTTGCGTAAACATTTAATTATTTTCT CACAAAGAATGTTGGCTTTTTTACTTTCGGCATGTG ACCTCTTATCATTGCTGCTACTGTTGATTTATATTTT TCTTCCATCTTTTCCAGGAGCCCTCTTCTTAGTGTAT ATGCTGACATGTCTGTTACATGTAAGGTATACTTGT ATGGCAATTGAC |
| 29 | Ambrosia artemisiifolia | Genomic | 268 | CAATTGGACTCTTGCCTGCCATGATGGGTGGACAG GCTGTTGAGGCTCAAGATGGACTTAGTGTCCAAGA TTGGATGAGAAAGCAAGTATGTAATCATTTAACTT ACTTTCTACCCTGCTATAATCATTTAATTCAGGTAAA ACAGACTGCATATATATATATTTTTTTATCATTTCT GTAGGGCATACCAGATCGAGTTACTACTGAGGTGT TTATTGCCATGTCAAAGGCATTAAACTTCATCAATC CAGATGAACTTTCAATGC |
| 30 | Ambrosia trifida | cDNA | 2016 | ATTCGAAACAAGGGCCGACCAAGTTCCAACAACGA AACAAGCCAAAAACCGTTCCAACCAACTACTACTAC TTCATCTTCTTAATCATCATCATCTTCTCCTCCTCTTT |

TABLE 1-continued

Weed species and PDS gene sequences

| SEQ ID NO | SPECIES | TYPE | LENGTH | SEQ |
|---|---|---|---|---|
| | | | | TAAATTAATAAAAATTAGAGCAGCAGCAGCAGCAG<br>CAGCAGCAATTGAGTTGATCGAGTCTCTTAGGTCA<br>TGTCTCTGGTTGGAAATTCTGTAGTAACGAGTCATG<br>TATTGTCGTTTAGTCAGGCGGGTGCTCATCGACTG<br>AAATTCCCGGCTGTCCGATTAAGAACCAACAACACT<br>GTCTACTGCCCTTTCAAGGTGGTCTGCGTCGACTAT<br>CCAAGACCAGACCTTGACAACACTTCTAACTTCTTA<br>GAGGCTGCCTACTTGTCTTCTACCTTCCGAGCTTCC<br>CCTCGTCCAGCTAAGCCCTTAAACGTTGTTATTGCT<br>GGTGCAGGTTTGGCTGGTCTATCCACTGCTAAGTA<br>TTTGGCTGATGCCGGTCATAAGCCCCTTTTGCTTGA<br>AGCAAGAGACGTTCTTGGTGGAAAGGTTGCGGCTT<br>GGAAAGATGATGACGGAGATTGGTACGAGACAGG<br>CTTACACATTTTCTTTGGAGCTTACCCAAATGTACA<br>GAACCTCTTTGGAGAGTTAGGGATTAATGATAGAC<br>TACAATGGAAGGAGCATTCTATGATTTTTGCAATGC<br>CAAACAAGCCTGGTGAATTTAGTCGCTTCGACTTCC<br>CAGATGTTTTGCCTGCACCACTAAATGGAATTTGG<br>GCTATCTTGAGGAACAATGAAATGTTGACATGGCC<br>CGAGAAAGTCAAATTCGCAATCGGACTCTTGCCTG<br>CAATGTTGGGTGGACAAGCTTATGTTGAGGCTCAA<br>GATGGACTTAGTGTTCAAGATTGGATGAGAAAGCA<br>AGGCATACCAGATCGAGTTACTACTGAGGTTTTTAT<br>TGCCATGTCAAAGGCATTAAACTTCATCAATCCAGA<br>TGAACTTTCAATGCAATGCATTCTCATTGCTCTGAA<br>CCGCTTTCTTCAGGAAAAGCATGGCTCTAAGATGG<br>CATTTTTAGATGGCAGCCCACCTGAAAGACTTTGCA<br>TGCCAATTGTTGACCATATTGAATCACTAGGTGGCC<br>AAGTCAGACTTAATTCACGGATACAAAAGATTGAG<br>TTAAACAAAGATGGAACTGTTAAAAACTTTTTACTC<br>AATGACGGGACTATCATCAAAGGTGATGCTTATGT<br>GTTTGCTACTCCAGTTGACATTCTGAAGCTTCTTTTG<br>CCTGAAGATTGGAAACCGGTTCCATACTTCAAAAA<br>GTTGGAAAAATTAGTTGGTGTTCCAGTTATAAACG<br>TTCATATATGGTTTGACAGGAAGCTCAAAAACACTT<br>ATGATCACCTACTTTTCAGCAGAAGCCCTCTTCTTA<br>GTGTATATGCTGACATGTCTGTTACATGTAAGGAAT<br>ATTATGATCCAAATCGGTCAATGTTGGAATTGGTTT<br>TTGCACCCGCAGAAGAATGGATTGCACGCAGCGAC<br>TCTGACATTATTGATGCCACCATGAGTGAACTTTCA<br>AGACTCTTTCCTGATGAAATTGCAGCAGATGGGAG<br>CAAAGCAAAAATATTGAAATATCATGTAGTAAAAA<br>CACCAAGGTCGGTTTATAAAACTGTGCCAGACTGT<br>GAACCTTGCCGTCCCTTGCAAAGATCTCCAATAGAA<br>GGATTTTATTTAGCTGGTGATTACACGAAACAAAA<br>GTATTTGGCTTCAATGGAGGGTGCTGTTTTGTCAG<br>GAAAATTTTGTGCCCAGGCTATTGTACAGGATTAC<br>GAGTTGCTTGCTGCGAGGGGGAGGTGATGGCTG<br>AAGCAAGCCTGGTCTAAGATGACGTGGCAAGTTGA<br>AAATTGATAAAACACCCATCCATCCATAGAACTTAT<br>CTTGTATCTGTTACTTTATACATGCATTGATTAATCA<br>GTATTTGAAATAGCAATTGCTTGTGAAAAAGTTTG<br>GGTGATGAACACAGTTTTGACTTGTTTATAGTTTTT<br>TTGCTAATAACTAGTAAAGATGATCG |
| 31 | Ambrosia trifida | Genomic | 2399 | ACTTGTATGGCAATTGACATGTTAACTACATTACCT<br>TTTTTACCCCACAGACGAAAGACTGTTAAACAAGTT<br>GCTCATATTATTCAGGAATATTATGATCCAAATCGG<br>TCAATGTTGGAATTGGTTTTTGCACCCGCAGAAGA<br>ATGGATTGCACGCAGCGACTCTGACATTATTGATG<br>CCACCATGAGTGAACTTTCAAGACTCTTTCCTGATG<br>AAATTGCAGCAGATGGGAGCAAAGCAAAAATATT<br>GAAATATCATGTAGTAAAAACACCAAGGCTAGTAT<br>TCACATGTGCAAACCGAAGACAAATTTGTTTATTCT<br>GATGAAGTATTAATTAATTATTGGGTTGTGGTGCTT<br>CAGGTCGGTTTATAAACTGTGCCAGACTGTGAACC<br>TTGCCGTCCCTTGCAAAGATCTCCAATAGAAGGATT<br>TTATTTAGCTGGTGATTACACGAACAAAGTATTTG<br>GCTTCAATGGAGGGTGCTGTTTTGTCAGGAAAATT<br>TTGTGCCCAGGCTATTGTACAGGTAATAAATAATTG<br>AGTAAGCATAAAACACAAACAAGGCGAGATTTTGT<br>GTGATCTCATGCATCATCTTGTTATGTTACACAGGA<br>TTACGAGTTGCTTGCTGCGAGGGGGAGGTGATG<br>GCTGAAGCAAGCCTGGTCTAAGATGACGTGGCAA<br>GTTGAAAAGTAAAAAAGCCAACATTTTTTATGAGA |

TABLE 1-continued

Weed species and PDS gene sequences

| SEQ ID NO | SPECIES | TYPE | LENGTH | SEQ |
|---|---|---|---|---|
| | | | | AAATAATTAACTGTTTTGCAAGAAGTAAGAGATGA CGACCTGCTGAAAAGTAGGTGATCATAAGTGTTTT TGAGCTTCCTGTCAAACCTGAAAATTGGCTGAATTA TTATTACCTTATAAGGAAGGATTAGCATTATATTGA AAGGGTCGGTCCATCTAACCAACCATATATGAACG TTTATAACTGGAACACCAACTAATTTTTCCAACTTTT TGAAGTATGGAACCGGTTTCCAATCTTCAGGCAAA AGAAGCTTCAGAATGTCAACTGCTTGATACAACAC AGCCAGTAAAGTAAAGCTTGTGGCCCCCAGAGAGA AATATGTGGAGACTTCAGCCAAATGGCGGTTTAAT TAACATACCTGGAGTAGCAAACACATAAGCATCAC CTTTGATGATAGTCCCGTCATTGAGTAAAAGTTTT TAACAGTTCCATCTTTGTTTAACTCAATCTTTTGTAT CCGTGAATTAAGTCTGACTTGGCCACCTAGTGATTC AATATGGTCAACAATTGGCATGCAAAGTCTTTCAG GTGGGCTGCCATCTAAAAATGCCATCTTAGAGCCA TGCTTTTCCTATTGATTCATTGTACAGCGGTCAATA ATTGAAAGAAATACAGTCGCGAGTTGCAGTGTCT TTAGACAACAACAATAATGAGCCATCTTTTTCTTTT ATATACATAAAACATAAATGAAACTAAACTCTTGTG ACATTAATTTATTCCAAATTACTTAATCAGTAGTAA GCTTGAAGATAATAATAATAATAATAATGAGTTTAC CTGAAGAAAGCGGTTCAGAGCAATGAGAATGCATT GCATTGAAAGTTCATCTGGATTGATGAAGTTTAAT GCCTTTGACATGGCAATAAAACCTCAGTAGTAACTC GATCTGGTATGCCCTACAGAAATGATAAAAATATA TATATATGCAGCTGTTTTACTTAAAAATCAACTTAT AGCAACTTAAATGACTACATACTTGCTTTCTCATCC AATCTTGAACACTAAGTCCATCTTGAGCCTCAACAT AAGCTTGTCCACCCAACATTGCAGGCAAGAGTCCG ATTGCGAATTTGACTTTCTCGGGCCATGTCAACATT TCATTGTTCCTCAAGATAGCCCAAATTCCTATAATA GGATGCAAATTAGAAAGATAAGATTCATAGTAGTG GTCGGTCTGAGGTAGTTGTAGTTAGTAGATAACTT GCCATTTAGTGGTGCAGGCAAAACATCTGGGAAGT CGAAGCGACTAAATTCACCAGGCTTGTTTGGCATT GCAAAAATCATAGAATGCTCCTTCCATTGTAGTCTA TCATTAATCCCTAACTCTCCAAAGAGGTTCTGTACA TTTGGGTAAGCTCCAACTGTGAAGCAAAGGGAAGA GTTAGTTAAAGCAGCTGATTTTCCATCCATTATTAG TTAGTTAGTTGAGTAAAGTAAAAACTTACAGAAAA TGTGTAAGCCTGTCTCGTACCAATCTCCGTCATCAT CTTTCCAAGCCGCAACCTTTCCACCAAGAACGTCTC TTGCTTCAAGCAAAAGGGGCTTATGACCGGCATCA GCCAAATACTTAGCAGTGGATAGACCAGCCAAACC TGCATAATAATAATAATAATAAGCAAATGAAAGTG AGGAGAAAGAAAGAAAGAAAGAAAAGGGGTGGG TACCTGCGCCAGCAATAACAACGTT |
| 32 | Ambrosia trifida | Genomic | 2377 | AAATATTAATGGTTGGTGCATATGCGCCTCGAGTG AAGGCAAAGGAAGCAACACCAACAATGTCAAAGT CTTATTTCCAGGTAATATGAAAAGCAAAGGAAGCA ATCAAAAGAAATTCTTGGACGAGCTGATGCAAAT TATCCCAACATTAAAAAAATTTTGTATACTGCCGAA CATGTAGCCATCCATCACAAACACGTAGTCCTAGAT CTTCATATGTGATCAACCTCGTGCAAGAATAAACTT CAAAGACAAAGAAAAATCAAATGATAGAACCCAAA ATAAGAGGATACGAATTTTTCATTTGATTAGACAAA TGAGGAAGATCCAAATCCAACTTGGACAAAGATGA AGAATGTTATCACCCGCACAACTAGGGGAATTCAA GGTTAAGCGGATTGTGGTATGAGGTAAGAAAGAA TACAATATAGGGGAATTAGGAAGTAAAGGAATAA GAAAAAAAGAATGATATATAGCTTTAGGAAAATC TAGGAGTGAGGAGAATATAGCAAAATATGAGGAA GTTAAAACCAAGACGAAGCAAGCGATATGTGAGA CAAAGTTAAAAGAGTATTAAGAGATATACAATAAG CTGACTCAAGAGAAGAGGATAATGATCTTTGTAGG ATAGCCTGAAGGAGACAAATGATTATAAAAGATAC TAGTTGAATGAACTATGAAGTGTGTCTTGGATAAA TAACAAAATAATATTCTCCAAGATGAATAGATATAC GATAAATGGAAGGAGTTTTTTGACGAGTTGTGCAA TGGATGTCAAGGGGCACGATAGAATACATCTTGAA GGAATTCTGAAAAGGTGCTTTTCTAGGAATGTAAA TTGTGAGAAAAGGAAGAAGGCGATCATCGGTAAA TCAATTGTCTTTGCTCACAAAATGTGACACCAACAT |

TABLE 1-continued

Weed species and PDS gene sequences

| SEQ ID NO | SPECIES | TYPE | LENGTH | SEQ |
|---|---|---|---|---|
| | | | | GTTGGATGGGGGAGAGAAGTTTTCAATGTTAACTA CTCTTTCGGTTATGTACGTAAGTATGTTTTTTTATGA GGCATCTTGTTCAAGAGCTCATCATTAATATAGAG GAGCAAAAACTTACAGATACCATCTTATGGACCAA GCATATATTGTTCACAAATAGATTCAAAACCTTTTA TATCTTCAAATATGAATGTGAGAAATGACTTCTCTT ACTTTTTTTACTTCCAGGTTTGGCTGGTCTATCCACG GCAAAGTATTTAGCTGATGCAGGTCATAAGCCCCT TTTGCTTGAAGCAAGAGACGTTCTTGGTGGAAAGG TTGCGGCTTGGAAAGATGATGACGGAGATTGGTAC GAGACAGGCTTACACATTTTCTGTAAGTTTTTACTT TACTCAACTAACTAACTAATAATGGATGGAAAATCA GCTGCTTTAACTAACTCTTTCCTTTGCTTCACAGTTG GAGCTTACCCAAATGTACAGAACCTCTTTGGAGAG TTAGGGATTAATGATAGACTACAATGGAAGGAGCA TTCTATGATTTTTGCAATGCCAAACAAGCCTGGTGA ATTTAGTCGCTTCGACTTCCCAGATGTTTTGCCTGC ACCACTAAATGGCAAGTTATCTACTAACTACAACTA CCTCAGACCGACCGACCACTACTATGAATCTTATCT TTCTAATTTGCATCCTATTATAGGAATTTGGGCTAT CTTGAGGAACAATGAAATGTTGACATGGCCCGAGA AAGTCAAATTCGCAATCGGACTCTTGCCTGCAATGT TGGGTGGACAAGCTTATGTTGAGGCTCAAGATGGA CTTAGTGTTCAAGATTGGATGAGAAAGCAAGTATG TAGTCATTTAAGTTTTTTTATCATTTCTGTAGGGCAT ACCAGATCGAGTTACTACTGAGGTTTTTATTGCCAT GTCAAAGGCATTAAACTTCATCAATCCAGATGAACT TTCAATGCAATGCATTCTCATTGCTCTGAACCGCTTT CTTCAGGTAAACATTTTCTTTCAATTATTGACCGCTG TACAATGAATCAATAGGAAAAGCATGGCTCTAAGA TGGCATTTTTAGATGGCAGCCCACCTGAAAGACTTT GCATGCCAATTGTTGACCATATTGAATCACTAGGTG GCCAAGTCAGACTTAATTCACGGATACAAAAGATT GAGTTAAACAAAGATGGAACTGTTAAAAACTTTTT ACTCAATGACGGGACTATCATCAAAGGTGATGCTT ATGTGTTTGCTACTCCAGGTATGTTAATTAAACCGC CATTTGCCTGAAGTCTCCACATATTTCTCTCTGGGG GCCACAAGCTTTACTTTACTGGCTGTTTTGTATCAA GCAGTTGACATTCTGAAGCTTCTTTTGCCTGAAGAT TGGAAACCGGTTCCATACTTCAAAAAGTTGGAAAA ATTAGTTGGTGTTCCAGTTATAAACGTTCATATATGG |
| 33 | Ambrosia trifida | Genomic | 2057 | GTCATCTCTTACTTCTTGCAAAACAGTTAATTATTTT CTCATAAAAAATGTTGGCTTTTTTACTTTTCAACATG TCACCTCTTATCATTGCATTGCTGCTACTGTCGATTT ATATTTTTCTTCCATCTTTTCCAGAAGCCCTCTTCTTA GTGTATATGCTGACATGTCTGTTACATGTAAGGTAA TACTTGTATGGCAATTGACATGTTAACTACATTACC TTTTTTAACCCACAGACGAAAGACTGTTAAACAAGT TGCTCATATTATTCAGGAATATTATGATCCAAATCG GTCAATGTTGGAATTGGTTTTTGCACCCGCAGAAG AATGGATTGCACGCAGTGACTCTGAAATTATTGAT GCCACCATGAGTGAACTTGCCAAGACTCTTTCCTGA TGAAATTGCAGCAGATGGGAGCAAAGCAAAAATA TTGAAATATCATGTCGTCAAAACTCCAAGGTGATC GATAAACTTGTGAAATTAAAATCGGATAATATCAT GCTACTGCTAGAAACAGCATTAATGTTGTGCCCGC GGGCTCTTTTATAGGTCGGTTTATAAGACAGTGCC GGATTGTGAACCTTGTCGGCCGCTGCAAAGATCAC CGATAGAGGGTTTCTATTTAGCTGGTGATTACACA AAACAAAAATATTTGGCTTCAATGGAAGGTGCTGT TTTATCTGGGAAGCTTTGTGCTCAGGCTATTGTACA GGTAATAAATAATTGAGTAAGCATAAAACACAAAC AAGGCGAGATTTTGTGTGATCTCATGCATCATCTTG TTATGTTACACAGGATTACGAGTTGCTTGCTGCGA GGGGGGAGGTGATGGCTGAAGCAAGCCTGGTCTA AGATGACGTGGCAAGTTGAAAATTGATAAAAACAC CCATCCATCCATAGAACTTATCTTGTATCTGTTACTT TATACATGCATTGATTAATCAGTATTTGAAATAGCA ATTGCTTGTGAAAAGTTTGGGTGATGAACACAGT TTTGACTTGTTTATAGTTTTTTTGCTAATAACTAGTA AAGATGATCGATTTAATGAGAGAAGATCTACTATG GTATGACGGCTTTAATAAACAACTTCAGTCCTAACC ATAACTAGGTATCAAATTTATGAATAAACATCACAG CTCACAGCTAAACATTCAGCTTTGATATCTATATGA |

TABLE 1-continued

Weed species and PDS gene sequences

| SEQ ID NO | SPECIES | TYPE | LENGTH | SEQ |
|---|---|---|---|---|
| | | | | AATCTCAGATGCTTTCTAATTAACTTCTCCAGGACC<br>AATTGGATTCTTTAAGTTTGTAGGAGTGTAGTTGA<br>GTTGGCGGTTCAAATTGATATCCCAACCATATTAGC<br>AGGTCCACATGTATTTATTTATATGTTTCATTTTCCA<br>TTCAAACAGTTGCTGTTGAAGGTACTAGTTAAGTCT<br>GCTGTTAAACAAGTAGATTGCAGATAACTTTGAGC<br>ATCATCAAGTTATATATACCGAATAGGATGCTTTTG<br>AAAGACATGAGCCGGAAAAAACGCTATGAGGTTG<br>ATCATACATTTTGTACGCACGTAAAACACAAATACA<br>AGGCAAAATAATAGTGTCTACAGACGACTGACTGA<br>TTACAGGTACACTAACCACATCTGTATTTCAAGGCT<br>GTGTGTTTTTATGTTTGCCCTTGTATCCGTAAATTAC<br>GGAGCCAATTGACCACTTCCTTAATCGTTGGCCGCT<br>TGGCGGGGTTAACATTTATACACATGCAGGCAACA<br>TCCCTTCTTGAAGCCCATTGCCCGGGTCAAATACTT<br>GATACTGTTTCCCTTCGGCTCTCAGTTGAAGCATCC<br>ACACAACCAGTTCTCATGAATGCTTGGACCTGAGC<br>CTAAATATCTCTATCTTGTAGGTAGCTCTAGCATCA<br>CAATCCCAAAACTATTCATTATCCCCTTTTAAGGTG<br>GCTATCAATAGACTGGCTGTACTCTGCTGGGATAT<br>ACCACCCATTAGTGGTGACATAGGTATTATAGTGTT<br>AGATCAGTCTAGACAACCCAAAATTGGCAAAACTA<br>CGCTTCAAACTGTGATGTATCTGATACTTAGTAGCT<br>ACTAACTATCTGGTCAGGAAACGGACGGTTTGCGG<br>TGTCAAGGAGCCAAAGGTATCAAA |
| 34 | *Ambrosia trifida* | Genomic | 1401 | TGTTTGTATCAAGCAGTTGACATTCTGAAGCTTCTT<br>TTGCCTGAAGATTGGAAACCGGTTCCATACTTCAAA<br>AAGTTGGAAAAATTAGTTGGTGTTCCAGTTATAAA<br>CGTTCATATATGGTTGGTTAGATGGACCGACCCTTT<br>CAATATAATGCTAATCCTTCCTTATAAGGTAATAAT<br>AATTCAGCCAATTTTCAGGTTTGACAGGAAGCTCA<br>AAAACACTTATGATCACCTACTTTTCAGCAGGTCGT<br>CATCTCTTACTTCTTGCAAAACAGTTAATTATTTTCT<br>CATAAAAAATGTTGGCTTTTTTACTTTTCAACATGTC<br>ACCTCTTATCATTGCATTGCTGCTACTGTCGATTTAT<br>ATTTTTCTTCCATCTTTTCCAGAAGCCCTCTTCTTAG<br>TGTATATGCTGACATGTCTGTTACATGTAAGGTAAT<br>ACTTGTATGGCAATTGACATGTTAACTACATTACCT<br>TTTTTACCCCACAGACGAAAGACTGTTAAACAAGTT<br>GCTCATATTATTCAGGAATATTATGATCCAAATCGG<br>TCAATGTTGGAATTGGTTTTTGCACCCGCAGAAGA<br>ATGGATTGCACGCAGCGACTCTGACATTATTGATG<br>CCACCATGAGTGAACTTTCAAGACTCTTTCCTGATG<br>AAATTGCAGCAGATGGGAGCAAAGCAAAAATATT<br>GAAATATCATGTAGTAAAAACACCAAGGCTAGTAT<br>TCACATGTGCAAACCGAAGACAAATTTGTTTATTCT<br>GATGAAGTATTAATTAATTATTGGGTTGTGGTGCTT<br>CAGGTCGGTTTATAAAACTGTGCCAGACTGTGAAC<br>CTTGCCGTCCCTTGCAAAGATCTCCAATAGAAGGAT<br>TTTATTTAGCTGGTGATTACACGAAACAAAAGTATT<br>TGGCTTCAATGGAGGGTGCTGTTTTGTCAGGAAAA<br>TTTTGTGCCCAGGCTATTGTACAGGTAATAAATAAT<br>TGAGTAAGCATAAAACACAAACAAGGCGAGATTTT<br>GTGTGATCTCATGCATCATCTTGTTATGTTACACAG<br>GATTACGAGTTGCTTGCTGCGAGGGGGGAGGTGA<br>TGGCTGAAGCAAGCCTGGTCTAAGATGACGTGGCA<br>AGTTGAAAATTGATAAAAACACCCATCCATCCATAG<br>AACTTATCTTGTATCTGTTACTTTATACATGCATTGA<br>TTAATCAGTATTTGAAATAGCAATTGCTTGTGAAAA<br>AGTTTGGGTGATGAACACAGTTTTGACTTGTTTATA<br>GTTTTTTTGCTAATAACTAGTAAAGATGATCGATTT<br>AATGAGAGAAGATCTACTATGGTATGACGGCTTTA<br>ATAAACAACTTCAGTCCTAACCATAACTAGGTATCA<br>AATTTATGAATAAACATCACAGCTCACAGCTAAACA<br>TTCAGC |
| 35 | *Ambrosia trifida* | Genomic | 649 | TGCCAATTGTTGACCATATTGAATCACTAGGTGGC<br>GAAGTCAGACTTAATTCACAGATACAAAAGATTGA<br>GTTAAACAAAGATGGGACTGTTAAAAACTTTTTACT<br>CAATGATGGGACTATCATCAAAGGTGATGCTTATG<br>TGTTTGCTACTCCAGGTATGTTAATTAAACCACCAT<br>TTGGCTTTGAACTTTGAAGTCTCCACATATTTCTCTC<br>TGGGGTCCATAAGCTTTGCTGGCTGTTTGTATCAAG<br>CAGTTGACATTCTGAAGCTTCTTTTGCCTGAAAATT |

TABLE 1-continued

Weed species and PDS gene sequences

| SEQ ID NO | SPECIES | TYPE | LENGTH | SEQ |
|---|---|---|---|---|
| | | | | GGAAACCGGTTCCATACTTCAAAAAGTTGGAAAAA<br>TTAGTTGGTTTTTCAGTTATAAATGTTCATATATGGT<br>TAGATGGACCCTTTCAATATAATGCTAATCCTTATA<br>AGATAATAATAATTCAGCCCTTTCACATTTTTTATTG<br>TGAACCCAATTTTAAGATAATGAATTACTACTCTTT<br>CGCTTGTGTACAACCATTCCAGATGATGTTTTTGAG<br>GATTATGAATCACAAGCAATGTATGCATCTACTGAT<br>ATAATGTGGTTAATCAAGGTAATGTCAACTTTCTCC<br>AAATTTCATTGTGGCTAATAAGTCAAAATGGGTTC<br>GCGCTGGTTGAGTCAAATTAAACCAGGTTGGATTA<br>AGTC |
| 36 | Ambrosia trifida | Genomic | 631 | TTTCTTTTCTGTCTTTCTCCTCACTTTCTTTTGCTTATT<br>ATTATTATTATTATGCAGGTTTGGCTGGTCTATCCA<br>CTGCTAAGTATTTGGCTGATGCCGGTCATAAGCCCC<br>TTTTGCTTGAAGCAAGAGACGTTCTTGGTGGAAAG<br>GTTGCGGCTTGGAAAGATGATGACGGAGATTGGT<br>ACGAGACAGGCTTACACATTTTCTGTAAGTTTTTAC<br>TTTACTCAACTAACTAACTAATAATGGATGGAAAAT<br>CAGCTGCTTTAACTAACTCTTCCCTTTGCTTCACAGT<br>TGGAGCTTACCCAAATGTACAGAACCTCTTTGGAG<br>AGTTAGGGATTAATGATAGACTACAATGGAAGGA<br>GCATTCTATGATTTTTGCAATGCCAAACAAGCCTGG<br>TGAATTTAGTCGCTTCGACTTCCCAGATGTTTTGCC<br>TGCACCACTAAATGGCAAGTATGCTATTATTTACTA<br>ACTACCTCATGCTATTACTTACTATGAATCTTATCTT<br>CATTCTAATTTGCATGTTATTATAGGAATTTGGGCT<br>ATCTTGAGGAACAATGAAATGTTGACATGGCCCGA<br>GAAAGTCAAATTCGCAATCGGACTCTTGCCTGCAA<br>TGTTGGGTGGACAAGCTTATGT |
| 37 | Ambrosia trifida | Genomic | 540 | CAACGAAACAAGCCAAAAACCGTTCCAACCAACTA<br>CTACTACTTCATCTTCTTAATCATCATCATCTTCTCCT<br>CTTTTAAATTAAATAAAAATTGAGCAGCAGCAGCA<br>GCAGCAATTGAGTTGATCGAGTCTCTTAGGTCATG<br>TCTCTGGTTGGAAATTCTGTAGTAACGAGTCATGTA<br>TTGTCGTTTAGTCAGGCGGGTGCTCATCGACTGAA<br>ATTCCCGGCTGTCCGATTAAGAACCAACAACACTGT<br>CTACTGCCCTTTCAAGGTTATTTTCTTCTTCTTCTTCT<br>GTCTGTAATTCTGTATATATAATATGGTAATGGTAA<br>TTTCCCCCCTCCCCTCCCCTCTCTTATTGCTTATTCTA<br>TTCTATTTATGTGAAATTAATATATAATAATAATAAT<br>AGGTGGTCTGCGTCGACTATCCAAGACCAGACCTT<br>GACAACACTTCTAACTTCTTAGAGGCTGCCTACTTG<br>TCTTCTACCTTCCGAGCTTCCCCTCGTCCAGCTAAGC<br>CCTTAAACGTTGTTATTGCTGGTGCAGGTACCC |
| 38 | Conyza canadensis | cDNA | 2432 | CGGAGAGACTTGCCTAACACACGAACTCCAAGTAC<br>AAATTCATCACCATATAAAAGTGTCACATATGCTTC<br>TTCTTCTTTTGATGATCCAGCTGGAGCTCCTTCC<br>ACAATTATCTCATTTAATAATAATAATAATAATCCTA<br>CTAACCCAAACCCTAATCTCCTCAATTTCATTTTTTA<br>ATCTAATAGTCTGATTATTAAGAGATTATAAGGAG<br>ATTAGAAATGAGGTTTTTGTTATACAATAAGATATT<br>ATTGTATTTTTAATCTTTTTTAAGTTTTTTGGAATTAT<br>TTTGGGGGTTTATGATAGAAATTGTGGCAACTGAA<br>TTTTTGGTGGGTTTTTTGAGAATTTGATTTTAAGGG<br>CTGGTGTTTGTCTGATCATCTGCAGCGAGCTGATA<br>GTATTATTATTATGTCTCTTTTTGGAAATGTCTCTGC<br>CATTAACCTAACTGGAAACTGTCTGCTATCAATCAC<br>TAGTTCCAGAGATGTTTTGTCATTTCGGCACGGTGA<br>TACTATGGGTTATCGCTTGCAATCCCCCCCTTCTTTT<br>ATTACCAAAACTAACAAAAATGTCTCCCCTTTGAAG<br>GTAGTTTGTGTCGACTATCCAAGACCAGACCTCGAT<br>AACACCTCTAATTTCTTGGAAGCTGCTTATTTGTCTT<br>CTACCTTCCGAGCTTCTCCACGCCCACCTAAGCCAT<br>TGAAGGTTGTAATTGCTGGTGCAGGTCTCGCTGGT<br>TTATCAACTGCAAAGTACTTGGCTGATGCCGGTCAC<br>AAGCCAATTTTGCTAGAAGCAAGAGATGTTCTTGG<br>TGGAAAGGTAGCTGCCTGGAAAGATGATGATGGA<br>GATTGGTACGAGACTGGTTTACACATATTTTTTGGA<br>GCTTACCCGAATATACAGAATCTGTTTGGAGAGTT<br>AGGCATTAATGATAGATTGCAGTGGAAGGAGCATT<br>CAATGATATTTGCGATGCCAAACAAACCTGGAGAA<br>TTTAGTCGGTTTGATTTCCCAGATGTTCTGCCGGCA |

TABLE 1-continued

Weed species and PDS gene sequences

| SEQ ID NO | SPECIES | TYPE | LENGTH | SEQ |
|---|---|---|---|---|
| | | | | CCATTGAATGGAATTTGGGCTATCTTGAGGAACAA<br>TGAAATGCTGACATGGCCTGAGAAAGTAAAATTTG<br>CTATCGGGCTCTTGCCTGCAATGTTAGGTGGACAG<br>GCTTATGTTGAGGCACAAGATGGTCTGAGTGTTCA<br>AGACTGGATGAGACAACGGGGCATACCAGATCGA<br>GTTACTACAGAGGTGTTTATTGCCATGTCAAAGGC<br>ATTAAACTTCATCAATCCAGATGAACTTTCAATGCA<br>ATGTATTCTGATTGCTCTGAACCGATTTCTTCAGGA<br>GAAGCATGGTTCTAAGATGGCATTTTTAGATGGCA<br>GCCCACCTGAAAGACTTTGCATGCCAATTGTTGAG<br>CATATTGAGTCACTAGGTGGCCAAGTCAGGCTTAA<br>TTCACGAATACAAAAGATCGAGTTGAACAAAGATG<br>GAACAGTTAGGAACTTTTTACTTTATGATGGAAATA<br>TTATTGAAGGTGATGCTTATGTATTTGCTACTCCAG<br>TTGATATTCTGAAGCTTCTGTTGCCTGAAGATTGGA<br>AAGCAATTCCTTACTTCAAGAAGTTGGATAAATTAG<br>TTGGTGTCCCAGTTATAAACGTTCATATATGGTTTG<br>ACAGGAAACTCAAAAACACCTATGATCACCTACTCT<br>TCAGCAGGAGCCCTCTTCTCAGTGTATATGCCGACA<br>TGTCTGTAACATGCAAGGAATACTATGATCCTAACC<br>GGTCCATGTTAGAGTTGGTTTTTGCACCTGCAGAA<br>GAATGGATTTCACGCAGTGACTCTGATATTATTGAC<br>GCTACGATGAGTGAACTTTCAAGACTATTTCCGGAT<br>GAAATTGCAGCAGATCAGAGCAAAGCAAAAATATT<br>GAAATACCATGTAGTTAAAACCCCAAGGTCAGTTT<br>ACAAAACTGTACCTGACTGTGAACCTTGCCGTCCAT<br>TACAAAGATCTCCATTAGAGGGATTCTATTTAGCTG<br>GCGACTACACGAAACAAAAGTATCTGGCTTCAATG<br>GAGGGTGCTGTTCTATCAGGAAAATTTTGCGCCCA<br>AGCGATTGTAAAGGATTATGAGTTGCTTGCTGCCA<br>GGAGGGAAGTGGTTGCTGAGGCAAGCCTTGTCTA<br>ACTGTATAGATGCAAGATAACTTGGTAAGTTAAAA<br>ATCAGTTGAAGACAAGAGCACGTGGTTCTTTGCAT<br>ATTTGACTTTTTATGGTCCTTGGCTGAAGTGGTAGG<br>CTTAAGGAGGTGGCAGAATTTCTGGGAGGAGCTTT<br>TACAAGTTCAGAAGAAGCTAAACATAAATACACCC<br>ATAGCAATTCATTGTTCTAACTGAAACTTATTTCATA<br>TTTGTCAAAGAAAAAAATACATATTCCTGTTATGTA<br>CATAGTTGGTTATTTTCCCTTGTTTTATACGTCATGT<br>GTGGCATCGAATCTATTGATTATCTATACGTATTAT<br>ATGTGGCA |
| 39 | Conyza canadensis | cDNA | 2206 | ACAACATCCCTTGTTTCCTCTTCTTCTTGTTTTCTTTT<br>TCTTTCTTTTTGCTAAAAAACTCACACACGCAGAAG<br>AAGAAGACGAAGACAAAGTCAGAGAGTTGAGTTT<br>GGACTGATTGATTGATTGTTATTAAGGGCTGGTG<br>TTTGTCTGATCATCTGCAGCGAGCTGATAGTATTAT<br>TATTATGTCTCTTTTTGGAAATGTCTCTGCCATTAAC<br>CTAACTGGAAACTGTCTGCTATCAATCACTAGTTCC<br>AGAGATGTTTTGTCATTTCGGCACGGTGATACTATG<br>GGTTATCGCTTGCAATCCCCCCCTTCTTTTATTACCA<br>AAACTAACAAAAATGTCTCCCCTTTGAAGGTAGTTT<br>GTGTCGACTATCCAAGACCAGACCTCGATAACACCT<br>CTAATTTCTTGGAAGCTGCTTATTTGTCTTCTACCTT<br>CCGAGCTTCTCCACGCCCACCTAAGCCATTGAAGGT<br>TGTAATTGCTGGTGCAGGTCTCGCTGGTTTATCAAC<br>TGCAAAGTACTTGGCTGATGCCGGTCACAAGCCAA<br>TTTTGCTAGAAGCAAGAGATGTTCTTGGTGGAAAG<br>GTAGCTGCCTGGAAAGATGATGATGGAGATTGGT<br>ACGAGACTGGTTTACACATATTTTTTGGAGCTTACC<br>CGAATATACAGAATCTGTTTGGAGAGTTAGGCATT<br>AATGATAGATTGCAGTGGAAGGAGCATTCAATGAT<br>ATTTGCGATGCCAAACAAACCTGGAGAATTTAGTC<br>GGTTTGATTTCCCAGATGTTCTGCCGGCACCATTGA<br>ATGGAATTTGGGCTATCTTGAGGAACAATGAAATG<br>CTGACATGGCCTGAGAAAGTAAAATTTGCTATCGG<br>GCTCTTGCCTGCAATGTTAGGTGGACAGGCTTATG<br>TTGAGGCACAAGATGGTCTGAGTGTTCAAGACTGG<br>ATGAGACAACGGGGCATACCAGATCGAGTTACTAC<br>AGAGGTGTTTATTGCCATGTCAAAGGCATTAAACTT<br>CATCAATCCAGATGAACTTTCAATGCAATGTATTCT<br>GATTGCTCTGAACCGATTTCTTCAGGAGAAGCATG<br>GTTCTAAGATGGCATTTTTAGATGGCAGCCCACCTG<br>AAAGACTTTGCATGCCAATTGTTGAGCATATTGAGT<br>CACTAGGTGGCCAAGTCAGGCTTAATTCACGAATA |

TABLE 1-continued

Weed species and PDS gene sequences

| SEQ ID NO | SPECIES | TYPE | LENGTH | SEQ |
|---|---|---|---|---|
| | | | | CAAAAGATCGAGTTGAACAAAGATGGAACAGTTA GGAACTTTTTACTTTATGATGGAAATATTATTGAAG GTGATGCTTATGTATTTGCTACTCCAGTTGATATTCT GAAGCTTCTGTTGCCTGAAGATTGGAAAGCAATTC CTTACTTCAAGAAGTTGGATAAATTAGTTGGTGTCC CAGTTATAAACGTTCATATATGGTTTGACAGGAAA CTCAAAAACACCTATGATCACCTACTCTTCAGCAGG AGCCCTCTTCTCAGTGTATATGCCGACATGTCTGTA ACATGCAAGGAATACTATGATCCTAACCGGTCCAT GTTAGAGTTGGTTTTTGCACCTGCAGAAGAATGGA TTTCACGCAGTGACTCTGATATTATTGACGCTACGA TGAGTGAACTTTCAAGACTATTTCCGGATGAAATTG CAGCAGATCAGAGCAAAGCAAAAATATTGAAATAC CATGTAGTTAAAACCCCAAGGTCAGTTTACAAACT GTACCTGACTGTGAACCTTGCCGTCCATTACAAAGA TCTCCATTAGAGGGATTCTATTTAGCTGGCGACTAC ACGAAACAAAAGTATCTGGCTTCAATGGAGGGTGC TGTTCTATCAGGAAAATTTTGCGCCCAAGCGATTGT AAAGGATTATGAGTTGCTTGCTGCCAGGAGGGAA GTGGTTGCTGAGGCAAGCCTTGTCTAACTGTATAG ATGCAAGATAACTTGGTAAGTTAAAAATCAGTTGA AGACAAGAGCACGTGGTTCTTTGCATATTTGACTTT TTATGGTCCTTGGCTGAAGTGGTAGGCTTAAGGAG GTGGCAGAATTTCTGGGAGGAGCTTTTACAAGTTC AGAAGAAGCTAAACATAAATACACCCATAGCAATT CATTGTTCTAACTGAAACTTATTTCATATTTGTCAAA GAAAAAATACATATTCCTGTTATGTACATAGTTGGT TATTTTCCCTTGTTTTATACGTCATGTGTGGCATCGA ATCTATTGATTATCTATACGTATTATATGTGGCA |
| 40 | Conyza canadensis | Genomic | 15961 | TAGTGTAATTTAATTATTAATATTAAGAGAATAGTG TATGTGAAAATCTTTTAAAGGTTTGTAGGCTTGTAG CCTTGTAGGTGAAAATATTACATAGGAGGGCATTT TAGACATTTCCCCATGTAACTTTCAACATGGAGGGT ATTTTCTTTAATATAGAGTATAAATAATGGAGATAT TTTAAAAAAATAAAGGACTGATAGTGTAATTTAATT ATTAATATTAAGAGAATAGTGTATGTGAAAATGTTT TAAAGGGTTGTAGGTTTGTAGCCTTGTAGGTGAAA ATATTACATAGGAGGACATTTTAGACATTTACCCCA TGTAACTTTCAACATGGGGGTATTTTCTTTAATAT AGAGTATAAATATAGATAAATAATATATATTTGTA AATTTTTTAAACTAATAAATTATTTTAAAATAATAAT TTTTATAAAATATATTTTATTTGATAAATAATAACTC TAAATTACACAGATGGTACCTATAATTTGTATTATA TTACATGTTTCATACCTCACATACAAGACACGTTGG CTACTTAATGATACAACTAACGACCGTCAGCGTGA GGTATCTTCTAAGTGTAAAATTGTAAACATGATATA ATTGACGTAATTTAAATCTAACAGGTATGAAATTAA TAATTTCGACCAAACCAAAGGTACTTAATTCACTCT TAATATACTGTATCTAATACTACTCGTGGTAGTATT ATGTAGATTCCTAGCAATGGACGACAATATTCCAAC AACATAAGAAGCCAAAACCCACTTCCTTCCTTTTTT TTTTTGTTGTTGAATAATTTAATCAGTTTTTAGGAAC GAACAACCTCCTCCATTTCCAGATAAATTATTATTCA GCCAAGCAAAAAACACAACATCCCTTGTTTCCTCTT CTTCTTGTTTTCTTTTTCTTTCTTTTTGCTAAAAAACT CACACACGCAGAAGAAGAAGACGAAGACAAAGTC AGAGAGTTGAGTTTGGACTGATTGATTGATTTGTT ATTAAGGTAAAAATACCACTTACTACTCCATCCATC CATCCATAGTAGACTGGTAGTTGTATTAGTAGTAGT TAGCTGCTGCTTTGGTTATTAGGATTAGGATGAAG AAACTAGCAGATTGTTAAGTATTCTTCATGTGACTT TGTTATCTTCCTTTGTAAACAATCTCCCCCAAATATA ATAGCATATCGACTAAGTGGTAATATACTTATTTTT TTTTTAAGTTGATGGTGAACTATTGTATATGGCAGG GCTGGTGTTTGTCTGATCATCTGCAGCGAGCTGAT AGTATTATTATTATGTCTCTTTTTGGAAATGTCTCTG CCATTAACCTAACTGGAAACTGTCTGCTATCAATCA CTAGTTCCAGAGATGTTTTGTCATTTCGGCACGGTG ATACTATGGGTTATCGCTTGCAATCCCCCCCTTCTTT TATTACCAAAACTAACAAAAATGTCTCCCCTTTGAA GGTACAACCTCTGCCACATGTATTTCATTATCACTC ACAAAATCAATTCTAATGTCTTTGTTTATCTGTGCTA AACAGGTAGTTTGTGTCGACTATCCAAGACCAGAC CTCGATAACACCTCTAATTTCTTGGAAGCTGCTTAT |

TABLE 1-continued

Weed species and PDS gene sequences

| SEQ ID NO | SPECIES | TYPE | LENGTH | SEQ |
|---|---|---|---|---|

```
TTGTCTTCTACCTTCCGAGCTTCTCCACGCCCACCTA
AGCCATTGAAGGTTGTAATTGCTGGTGCAGGTAAA
ACCTTCATACGTCATTATATTGTCTTTTAAGTCGCTT
TTGTTTGAGAATTTGATACTGCCACATCTGATAGAT
AACCAAATGATACTTCTAGTGTATCCCCAATGATGC
TTTTTATGCCACATACTAACATCTGCTTTAATTTGCT
ATCCCACTTACTTTTGCAAACTTCGCATATGCAGGT
CTCGCTGGTTTATCAACTGCAAAGTACTTGGCTGAT
GCCGGTCACAAGCCAATTTTGCTAGAAGCAAGAGA
TGTTCTTGGTGGAAAGGTAAACGATTTATAAGAAA
TTACAATAGGATCGGAAGTCCTAGGATCCCCCCTCC
CTCTTACCTTCTTCTATATAACAGAGCAAGCTTGGT
AATAAAACAAGGATTTTGGGTCTAATTATTCTCTTC
TTTACTTGCTTTCTGTTTTCGTCTCTTTCACTGATAAC
CAAAGGCAATATCAGTTAGGGTTCTAGGATGGGTC
GAAGCAAATTTTAGGGATACCAATGCCTAACCAAG
TTCGATCAAGACTAGGGATATAGAGGGTATTCAAT
CAGCTTCTGGTGGGATTATAGCTCGCGACTTTGAA
GCTAGAGTTAGGGTTCTTTAAAGCCTAACATAGTTC
AAATACGGCTGGGGTGTTGGGGGTTCCTTTCTGTA
CGAATTTAAAGCTGGACAAGGCAGCAAAAGAGTTC
GACTTGTGTGGATTTTTATCTAGGTTTGGCTGGGGT
TTCAAACAACCGAAGGTGTGTTTGGGGTTCTTGGG
ATAGTCGATCAACATTGGAGTGTCTTTTTCCTGTTTT
ACAAGTTAGAATACGTGAAATGCATCTTCGTTCATT
ATTTTGCTTTTGACCTTTATGTGATGGGTACAAGTT
TAACAACCTACTGCATGCGGTTTCTCTTTGTGCTCA
CATTTCACTTTCTCTCTTTTCTCTTTTGCATTGTTGGG
GTGGGATGGCTGTTTTTGCTAGTAACATTTATACAA
ACCTGGACCTAATGTTAGGTCAATCCGGGCTGGGT
TCACAACTGGATGGAGGAATAAGGGTCGGAGGGA
AATATTGAATGGCTCCTCAAACCCAAAGTAACCCA
GATCCAAACACTTCCAATCTAAACAACCCAGACCCC
GTGGCTGCTCAATCAACAGCCATAGCATCATCTATG
AAATCACTGCAGCAAAGAGGTAGCAATGATCAAGA
CACAGTAAGCCAAACAAAAACAGAAATCAAGCGG
CAATTTAAATCAATTTGAAGATGAAGGTTCATCTGG
TGGTAACCACCGTCACTACAGACCTTATAATAATAT
CGATTTCCCAACTTTTAGTATTGGAGAACTGTTTAC
AAGGCTATGAGTATTGCTATCGAGTTTGAATCCAA
GGTTCACATGAAATTTAGGAAAAGTTTTTCGTCTTC
AGCCAAAACAGAATCAGTACCTTCGAAACCAATAG
AAACTTCCAACCTGTTGCCCTCGATTGCTGCTGCCC
AGAAACCAACTGAAGCCCGTCTTTTTGATGTTAAAA
AATAGGGCAGATTCATACGAGAAGTTGTGTCTAAG
TTTCTGATCTACTCAAAATTTCTATCAATTTGCCTTG
GGGGAAAGCCGATGTGGTACTCGGTATTCAATAAT
TAGGAACACTTACAAAGTTTAGGCAAAATGGAAGG
AGATAGTCATGAAGTTCACTATGGATGTTAAGGAG
TACAAGCTACATGGACTTCCACCAGATCGTCAACCA
TCAGCAACATTTAGCGACCTCACTACTGAACCATTC
GAGTTACAGGCAAGTGGACTAGCAGCTCATTTTTT
CACAACTGGCTAGTGGACAAGTCAGATTTTGGGGC
CGGATGTATTGATACAAACCTGGACCCAATGTTGG
GTCAAACCAGGTCGGGTCAGCAGCTGGATGGAGG
GAAAAGGGGTGGAGGGAAATCAAGTAGTGAAGG
AATTCAAGTTAGGAAGTGGACCATGCGCCCACTAC
ATATAATTGCTCCACTAATTTTAGTATTATATATGTG
TGTTTTTCTGTTTTTTAAGCTGGTCAAGATACTAAGT
TTGTGATTGTTCTTGTATTCGGAGATTTGCCATCTG
AATTTTGCTAATATTGTGTTAGACTCAGTAATCTAA
ATTAGTAGATTTCCAGTTTCTATCAAATGTTCGTTTG
GCGAAAATGAATAATTGAAGTTCATATGACGACCT
TATTTGAGCAGGATCTGTTCTATAGGCTCGTACCTC
TGTATCCTTGATTCCTATCAAGACAGAAAAGTAGTT
TCATATGAAATTTCTATTTTTAAACTTTTGTATATCA
TAAGTAGTCAAGCTTAGCTTAATTTCAAATCTAGGT
TGTCTTAGTATGTTGTTACTTATCGTGAGTGTTTTTA
TCCACATTGCTCTTCTCACATAGGTAGCTGCCTGGA
AAGATGATGATGGAGATTGGTACGAGACTGGTTTA
CACATATTTTGTAAGTTTTAACTTCTTATATCCTTTC
AAGTGTCGAAAAAGAGAGCTGATGTGTGCATAAA
AAGTTATTCCCATAATATAATTCTCAACAGGGTTGT
TGTCGTCTTTTTTGTGCACTATCTATCTGCTCTAAGTT
ATTGTTTCTCCACGTACCTTTCCTTTTGGACATTTGT
```

TABLE 1-continued

Weed species and PDS gene sequences

| SEQ ID NO | SPECIES | TYPE | LENGTH | SEQ |
|---|---|---|---|---|
| | | | | CACTAGACACCTAATGTGCAATAAACTTCTTCATTT GCTTGAAGTTGGAGCTTACCCGAATATACAGAATC TGTTTGGAGAGTTAGGCATTAATGATAGATTGCAG TGGAAGGAGCATTCAATGATATTTGCGATGCCAAA CAAACCTGGAGAATTTAGTCGGTTTGATTTCCCAGA TGTTCTGCCGGCACCATTGAATGGTAAGTATGCTAT TATTAGCCTATTTTTTTTGGTGTATATATTTTATTTA AATGATTTGGTGGTGAGCATTTTCTGCATCACCAAC ATGACAAAAAAGATCTAAAACAAGATCAGTCAGGG AATGCTAGATTACTAACAAATGTGACTCTGCATACC ATCTCAGGAATTTGGGCTATCTTGAGGAACAATGA AATGCTGACATGGCCTGAGAAAGTAAAATTTGCTA TCGGGCTCTTGCCTGCAATGTTAGGTGGACAGGCT TATGTTGAGGCACAAGATGGTCTGAGTGTTCAAGA CTGGATGAGACAACGGGTATGTAGTCGTTTATGTA AATATTTCTTTTACCATTTTTTAGTTTAATACATAAG AAACAATGGCCATGATACCTGGTATATTTGATAAT GGTAACGTTTCTAAGTGGAAGATCCAGAGGTCAAA CCTTAGCAGGGGCTTTTTTTAGGAAGATTGTTGGCT AATTAAACCCCCTGCTTAATAATTCGAGTTCTTGTTT CTTTTGTTATGAATTTTATTTAATAATTAATGCACAT TTTTCATTTTTCCAGGGCATACCAGATCGAGTTACT ACAGAGGTGTTTATTGCCATGTCAAAGGCATTAAA CTTCATCAATCCAGATGAACTTTCAATGCAATGTAT TCTGATTGCTCTGAACCGATTTCTTCAGGTGAAGGC ATCATTCTCTTAGAGCTTACTGGTTAAATAATGATG AAAAATTAATCTCATGACTTTTAATTCCATCTTCCGT CTGTCATATATGATAAGTTGGTCACGGACTCAAGTC ACTAATATATTATATGGATTGATTTTACGCTTGTGA TTGGTCAAGTAGACAAAGCATGCAAAGTTATATGG GTTTAGTGTAATTAGTGTCTGTTGCATTGCTCACTG TATGTCTGTATTGGTTGCTATAAGCCAGCGTGCTAC CTTGAAAGCAACTCTATTTCCTTTTCCATGATCAAGT ATTATTACATATATATTGTGCTTCTAGAATCCAGAT ACAGAGATTTGGGTTATTTTTGTGGTTTTGAAATAG GAGGGCGGCCTCTATAGTTAATCTCGAAGTGCTTA TTGTACACCATGGATTTTTGAAACAAAGAGTTGATC GCTCTTATCTGTAGCTTCTTAACACTTCAATATTGGC TTGGTTGCAATACTACATGGCATAGACATTGGACA CCATAGATAATACAACTTGTAAATTGTTTGTAATAA ATCAACAGGAGAAGCATGGTTCTAAGATGGCATTT TTAGATGGCAGCCCACCTGAAAGACTTTGCATGCC AATTGTTGAGCATATTGAGTCACTAGGTGGCCAAG TCAGGCTTAATTCACGAATACAAAAGATCGAGTTG AACAAAGATGGAACAGTTAGGAACTTTTTACTTTAT GATGGAAATATTATTGAAGGTGATGCTTATGTATTT GCTACTCCAGGTACATTTAGAGAACGACTATTTGA ATCTGTAGCTTTCACATGTCTGTTGGGGTTGTAGCT TTATTGATTATTTTGTGTCAAACAGTTGATATTCTGA AGCTTCTGTTGCCTGAAGATTGGAAAGCAATTCCTT ACTTCAAGAAGTTGGATAAATTAGTTGGTGTCCCA GTTATAAACGTTCATATATGGTTAGTTGGATCCTTC AATATAATTCTAAACATGGCACAGTAATCATTCACC TTAATTTAATAGAGTCTGGCTTCTGTCTTGACCATT AATCTGACTTAGTAAAACCCCTATATGTATTCTTTGT AATTGTTAAACACCACTTTCAGGTTTGACAGGAAAC TCAAAAACACCTATGATCACCTACTCTTCAGCAGGT CACCTCTCAACTCTTATTCTTGCAACACTATTACTTA ATTTTTAGTAGACAAGGCTGTTGAGCTTTTTATTTG TATGTTATTCATGCCACTGCTACCTAAACGGATCTT TTACTTCCATTTCAAATGTCTGGGGCGTGTCGTCCA TAAAGGTTCTCTACAGTTCATAGAGTAACTTAGAGT AAGCTTACACCCCACCTATTAACTAAACAAAGCAAC ACAAGTTAGGCTATATGGTACATGCTAAAGTGATG GTCAAGATTGCACCATTTGCTACCGCCTTGAGATAC CAGTGTCCCAGCTTCTGCTTACACTTCATAGTTTATA CTCAAATTTAATATTGGTACAAAAAAGAGTACTGA ACCTATCAGTTTAGTCTTTTGTATTAATTATTTAGTT TGCATGCAGGAGCCCTCTTCTCAGTGTATATGCCGA CATGTCTGTAACATGCAAGGTAAAGACAAGACAAA CATATATGAAACAAACCATTTTCTTCCAGACAAACC TGCTTTGCTGTTTTCATATGGTTCCTTGTCATGCAAA CAATGAGGAGATGGATGTCTATTGGCCTCTCCTCTC ATTCCTATTTTCCCGGAAAATGGGTTAAATCTGTCT TTGTAATTTTATCTTTGTCGCATGCATGGGACATAA |

TABLE 1-continued

Weed species and PDS gene sequences

| SEQ ID NO | SPECIES | TYPE | LENGTH | SEQ |
|---|---|---|---|---|
| | | | | CTTCTCACAATGCACATAACTCAAATATTTACCAAA ACCTCCCGCATTTTTAAAACCAGGCTATATATAAGT TGTAAATTACATGATGTGAACCCATACCTCCCATCA AGGTTGTTCTGATAATAGTGCTCCCATTTTATACAG GAATACTATGATCCTAACCGGTCCATGTTAGAGTTG GTTTTTGCACCTGCAGAAGAATGGATTTCACGCAG TGACTCTGATATTATTGACGCTACGATGAGTGAACT TTCAAGACTATTTCCGGATGAAATTGCAGCAGATC AGAGCAAAGCAAAAATATTGAAATACCATGTAGTT AAAACCCCAAGGTTAGAAATATCTTACCAGTAAGG GGTTTTCAACGATTCGGTTTACGAGCTCTTCGCTTT GGTTTCCTTGATTTGACAATCCTTGAAGCTCAAACC AAAAACCAAATCAAACCGAATTAATCAGAAACAAG CCAAACCAATAAGATGGTTTGGTTTTGGTTCGAAT GCGATTGAAACCAAACCATTTTCAAATAATGCAGAT TTTATGCTGGCAAATGTTATCTAAACTTTTTGGCAA ATGAAAATTTGCTGAGATTCATTTACCACCAAAAAC TTACTATATGAAAAGAAATATATAATGTATTATAAA CTTACATTATAAGTTATTTTAAATTAATTTGATAGG AAATATATATATATATATACACACACATGTATAT ATATATAGACCAATTCGGTTTTCGAATTGGTTTTGT TTAAAAAGCAACAACTCGTAAATCAAATTATCAAAC CATAAACCGAATTTCAAAATCAATTTGTTGTCAAAC CAAACTAAAAACTCAAAAAAACCAAATGAATTTCA ATAAATTTTTATTTCAATTTGGTTTGATAATTGGTTT CATCGACTTGGATCCGTACACTGAACACCCCTACTT ACATGTACTAGTACTTTCTGTAGATTACTTAGCATG TGAACACCTTCATGTTTCACCCATCTGTGAACGTTG TAAACTTAATTTTTGTACAGTTGTATCTGCGATATAT ACTAGTTTGTGACCCAATAGATAGATTATTAATTA TCATATAGTTATGTAATTATATTTCCATGTATTGTTT ATTCTATTTCATAATTGTGTAACAGGTCAGTTTACA AAACTGTACCTGACTGTGAACCTTGCCGTCCATTAC AAAGATCTCCATTAGAGGGATTCTATTTAGCTGGC GACTACACGAAACAAAAGTATCTGGCTTCAATGGA GGGTGCTGTTCTATCAGGAAAATTTTGCGCCCAAG CGATTGTAAAGGTAATGTTAAAGCAACTCGTAGCT GGTAGTTTTAGAATTATTTAGCAAGTGAAAGTATTT TTCTCTGCTGCTTTTTAGAGTAGTGCAATTTGCAGC AGACGAATTTTGGGTATGTGTTTATAAGTGACCAT AAAAAGACAAAGTAGCCTACATATTCTGTTGCTCAT CTTCTGATGCATCATGTAACACAGGATTATGAGTTG CTTGCTGCCAGGAGGGAAGTGGTTGCTGAGGCAA GCCTTGTCTAACTGTATAGATGCAAGATAACTTGGT AAGTTAAAAATCAGTTGAAGACAAGAGCACGTGGT TCTTTGCATATTTGACTTTTTATGGTCCTTGGCTGAA GTGGTAGGCTTAAGGAGGTGGCAGAATTTCTGGG AGGAGCTTTTACAAGTTCAGAAGAAGCTAAACATA AATACACCCATAGCAATTCATTGTTCTAACTGAAAC TTATTTCATATTTGTCAAAGAAAAAAATACATATTC CTGTTATGTACATAGTTGGTTATTTTCCCTTGTTTTA TACGTCATGTGTGGCATCGAATCTATTGATTATCTA TACGTATTATATGTGGCATGTTTTTTTTTAATTTTGC ATCCTGATCTTTGATTACACTTTTCAAGATTTATTCA CTTTGCTTCCATGGCATACAAGAAAACAATATCAAT ACAGCGAGCTATCTATTATCTAACTTGGGAGATGC AGGTGCATGAGAAGTGCTCAAAACTTCAACTACTT GGTGGGATTAAGTTGAAGTGACACTAACCCAGGTA CCAACCTCATCCCGAAAATCTGTGAATATTTTCTTTT TATTCGTCTTAGTTAAAAAAAGAAAAAAAAGAAAC AGATGATGCACCAGTTCAATACTTTTTGTTCGATAC CTTGATTATTTACCAAATGAGACACACTGTATGTCT GTATGTGCTTTCATCTTGTTTCATTTTGTGGGAATGT GGAGTAACAGGTATAAGAATAGCAATAACACAAGT CTAGTTGCTGAAGAGTGTGAGCAGAGTAAGATTTT GGTATGATACCAAGTAAAGTAAATGCGTAGAGAGT AAGGTTTAGGTGATTCCTTAATGAAATGGGAACCT TGTGATTGTCAATGAGTTATTAATCCATTGAATTTG AAATTTCACAACGTGAAATAACTTGTGCTCTTACAA AATGTTTTGTGGTCATATATTTACCAATACATGTGT CTTCTTGGACACTAAAAAAAATAGATAGCTGGTGA AGATACTATATAATTTAATAATAAGATAAGATAGC GTCTACTTTGCTGAAAAGTCAAAACTGGATTACCAA ATCTCATTCTCACGTGTCAAAATTTGACAGGATCTT TTGAAATTCACTTGTTGGACATTGGCACTGGATCAT |

TABLE 1-continued

Weed species and PDS gene sequences

| SEQ ID NO | SPECIES | TYPE | LENGTH | SEQ |
|---|---|---|---|---|
| | | | | GCAAAGGGATCACATTTCTCTTCAAGCCTTATCCCA
TTCCCAGCTATAGATACCATAAATATAAACGCTGGA
AGTGCAGTATTGAATTACCTGATTTATGTTTTTGGA
TGTGGGGGTTTTAGGAGGTGATATGTAATCAAAA
ACTTAACCCAATCCATTCAAAGATTGTGTGTTGTGA
TATGACCTAAAGAAAGTGAGAGAGAGAGAGATTA
TTCTTAATTCTAAAGTAATAAATTGTGAAGGCAAAT
AAGCCGACAGCATGTTCCTGATACACATATCCATCA
CAACATCCCCTCCCAACTTTGTCACTTCCATTTTACT
CCACACTATATATACGCACACCTCTTTCAACAATGG
CTTCTACTGTACAGAACATCCCCACTTTTTTGAGCTT
TTTCACGGTGTCTGCATGAAGTTAAGAGTTTGACAT
CTGCTCGCATTCACCCCCCCTTTGGCCTTGATTTCTT
CCCACATATAACTTCAAACTTAATTAATGAATTGAA
TGCGACCCGACTCTTTTCCATGCAAATCAGTGGTCA
CTTATCAATGTTGATTGTTGACTCGATCCCATCTATA
AATACCCCTTCTTACCATTTTCTCTCTCAGGGTCCCA
GCTCCACATCTGTGAGGCTTTTTTTCTTTTGGTCCCA
AATCTTTCAAAAAAACACAAACAGAAAATGGCAAC
AGCTTTACAAACAAAGATAGAAGGGAATCGTATTA
CAACAAAGTGTGCTTCCTTAGTAAAGAAACAGCGA
GCTCGTATATATATCCTACGTCGTTGTGCCACCATG
CTTCTCTGCTGGTACATTCAAGGAGATGAATAAATA
GTTGATGCTATGACACAAACAACAGACATGTTTTTA
TCCTCGATTCTTATAGTCTCTATATCCCTTTTTTCACA
TCAACTCATGTGGCTCCCGTTTTCGGTTCTTTTCTTT
GGCTTATACATATTCTTAAATATGCATGCCCTAAAC
TTCCATCTTTTTAACACCAACGGTCCGTTGCATTTAA
AGGCTGTTGGGTCTTGTCTCATTTTCTACTCCCTAGT
TTTTGTCATGTCTTGTTTATCTTGACCTCTCTTCATTT
GTCCTGTTTAAAACACTTTTTTTATCCAAATGGTTTT
CATTTGGGTTTTTTGGGCATCTGCATCAGAGGACA
ATTTCAACTTTAGACATGGACCAGAAACGGGGATA
TGACCAGCATGAAGGAAGCAATCTTGCATCAAGTT
GGCAGCTTGAAATGAAGGTTCTACAATAACATCTT
GCGTTGTGTCATGGTTTGTAGATAATTGTCTCCGCT
GAAAATAAATGACGGTTCCTCACTTCCTTGATATGT
AAAGCACTCATAAAATGATTAATAATTCGGTGCTGC
TACAAATATATATGTTGAAGCGCACTAAATCTGAA
GTTGTGATTTATTCATCGGGATGTTTTTTTCTTTTTA
ATAATGACTTTTTCATCATTTAAGTTGACATATACA
GCACCCACTAATGCTAATATCTTAAATCTCCACATTT
CCCTTGCAATCACCAAGACAACTTGCTGTTAGCATA
ACCAGACACTGCTACTAACTTTAACCATCAAAAGCA
CATAATCCCGCAGGTCTTCAAATCCAAATGAGGCC
GGACATCATAGAACTTGTAATTTTAACTCACATAGA
AGTTTGATAGTGTGATATATGACAAGGGCAGATGG
TAATAAGTAGAGCTAGCAAATCCTTTTCATATTGTT
AATCCTCTCTCAAAATGGACGAGGAAGCTCTAAAA
CTGCAGAAAACAAACTTTTACAAACGAATTTAAAG
CTTTAAGAGGGAATAAGGAACAGGCATGTCATTGA
AGAATGCTATCTATTTATTATGGAAGATCTGTGACC
TTAAAATCCCATAAATATGATATGTGTCGGATCGTC
CAGAATGAAAAGTAGCTCAAGTTGTTAGAAATGTT
AAGTAGACACAGATGTTGTATGAACTATGGAAGT
TCACTTATCTACTGTAATGAGCTTCCATCTCTCCCAA
TGAATTCCAAAACCCTGACTCACCTTCAAATTAATT
CCAGCTCGTGAACCAAATTTGTGATTCTGGACACCA
ACCCTTATCAAAGAATTTAATTAAATTGGCAATTGA
CTTGAGATGTTTGAAATTCAATTTTAGAGAATAGAA
GTTTCATACAATCAACGAATGAACTTTATTACATCT
GTGTATTTTAACAGCGTACGTTTCCTGCTTAACTCG
AGTGCTGGATCCAACCCATATCAAAATACGCATGTT
ACCGGCGCATCTGGTCTAGTCTGATTCCATGGATAC
ATGTTCCGTGTTCCGTTCAGAAGGTTATGTTTCTAC
CAGAAGACAGTTACAGGTACTGGTTAACAAGTCTA
TTGTAAATCATATACTTTTACAATGGCATTGATGTA
TCTGTTAACATAGTGGAAGATGCGGTACAAAGGAA
TATGAACAGGCTTCTTTGTGAAAGATGTATCTATTC
AACAGCCAGCCATAGCTGGAAAAAGTGTCTCTATA
GTCTATATACATTAATGCACGGTCATCAGGTAAAAA
TTCCTTTGCAAAAGGAACCACAAACAAAAAGCAA
AGGCGAGTAAAAAAAAAAAGAACCTAAGTGAGA
GATTGCCTGCACAGACAACTAATTACAATGTACATT
GACTCGCACACTTCGCAATGACACAATACTCTGATT |

TABLE 1-continued

Weed species and PDS gene sequences

| SEQ ID NO | SPECIES | TYPE | LENGTH | SEQ |
|---|---|---|---|---|

```
TCTATATATATGTGTATGTGCATTTACATTTGCCCTT
TATTTTGGTATCCGATGGTTGGGCCCAACATTATGG
AGCCAATCAACCACTTCATTAATGGTTGGCCTCTTG
ACGGGGTTTACGTTCACACACATACAGGCGACATC
AAGAACCTGCAGCATCTCTTCTTCAAATCCCTTGTC
TCTCAGGATCTCATCAAATATTTGATCCTGTTTCCCT
TCTATTCTAAGTTGTTGCACCCACACAACCAATTCTC
TAGACGCCTTTGGCCGGAATACCTCCATGGGCCTCT
TTCCTGTAAGCAGCTCAAGCATGACAACCCCAAAA
CTGTATATGTCCCCTCTCAAGGTGGCTATCCATGAC
TGGCTGTACTCCGGTGGAATATACCCCAGGGTGCC
CACCAACTCAGTCGTGACGTGTGTATTGTATGGAT
GAATCAATCTAGACAATCCAAAATCGGCCACGTAT
GCTTCAAATTGGTCATCCAGAAGGATGTTACTTGAT
TTGATGTCACGATGCACGATATGTGGTTCGCATACT
TGGTGCATATAAGCCAGTCCACAACTTGCTCCCCG
GGCGATCTTCAATCTCGTTGGCCAATCGAGCCTGG
ATGCTCCGTCAGCCTTCTCATGTAGCCAGTAGTCCA
AGCTTCCATTTTCCATATACGAATAAATCAGCAGCT
GACATCCATCATGTACACAGTACCCTTGTAAAGAAA
CCAGATTTTTGTGATGGGCAGTTGATAATGCCTCCA
CTTCTGCTTTAAACTCCCTTGCAATGAGGCCCATAT
CTCCTGAAAGTTTCTTGACAGCCAGTTTTGTTCCGT
TCGCCAAAGTTGCTTTGTAAACCAATCCAAAGCCCC
CACATCCAATGATGTTTGCTTGACTGAAATCTTCGG
TTGCTTTCAAAATATCAGTTATGGTTAGATGTTTGA
TGTCTTTTGCATTGTGCGGGAACAATATGACTCCGC
TGGTATCCTTGGGAACCTCTACGGCCGACGTAGAA
TTGAAGGACACCGTGTCCATATGGAAGACTTCCGG
GTCACCTCTGGGGAGAATCCTTCTTTTGGACAATAT
CCACAGTGCCAGACAAGCCAGAGTGATGCCAACCC
CAAAACAGATGCCCAGGATGAGGCCGACGATGAG
TTTCTTGTTTGGGCCTTTTTCATGTGGCGAGGAAGC
GTCTGTTTTGGGTGATAGAGGATTATTTTCATCGTT
GCAAAGGTTTTGCATGGGTGGACCGCACAACCCTG
GATTGCCTTCGTAGTTCTGGTTCAAGAAGGTGTCA
AACTGTCCCCCGGTCGGTATGGAACCTTGTAGCTT
GTTGTAAGCGACGTTGAAAGAAGACAGAAAGTAC
AAGCTTTTGAGGGAGGCAGGGATCTGACCAGACA
GATTGTTATGGGAGAGGTCCAGCTTTTCCAAGTTT
GTGAGATTTGAAATGGTAGCGGGAATGGAGCCAG
AGAAATTGTTTAGGCTGAGATCAAGTGTATGAATG
GACTGCATATTACCAATCTCAACAGGTAGGCTGCC
ACCGAGTTGATTGCTTGACAGGTACAATGCTGGAG
GCAGGGTGGCCAGCTGATTGTACTGCAAGTAGGAT
GCATTTTGAGGGGCAACGAATACAGGGAGTTCCA
GGTAACTGCTGTTTACACGGTCCAAAACCTGCTGC
GATGCGAGGGCTGGGAGTCTGGTAAGCTCCACAG
GGAATCCCCCGGATAGAGAATTATTAGACAGGTCC
AGATAGAAGAGGTTCGGAAGCGTGTGTAGCCAGC
CCGGAATGACGCCGTCGATATTATTCTGGGAGAGG
TCGATGACCTCCAGATTGGTAAGGGAAGAGAGCCA
CGTGGGGATCTGACCGAACAGCTTGCAGCCACCAA
GACCCATGATCTTGAGATTGGAGAAACCAGAGATG
GGTTGAGGGGGAGGGGTTCGTTGAAGAAGTTCT
TGGAGAGGATGAGGGTGGTGAGTTTCGGATGCCT
GCTCAGGATATTGAATGCGCTTGTGATGTTCCTGA
GGGTGTTGTTTGAAAGGGAGAGGAAGGAGAGAG
CAGGCAGGCCGAGGACATGAGCGGGGATTTCCCC
TCGCAGCCTGTTGGTGGCCAGCCGGATTGCGGTGA
GCGATTTGCAAGAGAAGACGGTGGCCGGCAGCTC
CCCTGCGAATCGGTTTTCGCCAAGGTCAAGGATGG
TGAGCCTGGTGAAACCGGAGAAATCAAAATCCGA
GAGAATGCCGGTGAAGGAGTTGACCCTGAGATTG
AGAAGCTGCAGGGATTTGCAGTTGACGAGGGAAG
GAGGAAGGGTTCCATTGAGACGGTTGATGTGAAG
TTCAAGTTTCTGCAACAAGGGGAGGTTGCCAATGG
CGTGGGGATGGGCCCGCTAAAGTTGTTGCCAAAC
AAGGCAAGAGTGGTGAGGTTGGTGAGGGTGGTGA
TGGAATCGGGAATGGGGCCGGTGAGAGAGTTCCC
AGGGAACGATAGATGGCGGAGGGAAGGGGTGGT
GGAAACGTGGAAAGGGGCAAGGGCGCCGGTGAG
GTTGTTAAACCCCAGACTCAAAACCTGGAGGGAAG
CACAGGGGCCCGACAAAGGGGGGAAATCCCCGGT
GAAGTCGTTCAAGGAGAGATCGAGGATGGTCAGA
```

TABLE 1-continued

Weed species and PDS gene sequences

| SEQ ID NO | SPECIES | TYPE | LENGTH | SEQ |
|---|---|---|---|---|
| | | | | TTAGAGTTGCATATGGTGGAGGTGGGGACGGGGC<br>CTGTCAAGGTGTTGTTGCTGACATTGAGGGCAATC<br>AAAGAAGGGAAAGAAGGGAAGAAGGTAGGCGGA<br>ATCGTGCCATTCAGATAATTACTGGACAGATTCAG<br>GGTGGAGATGGTGGTCGTGGTGGGTTGTGGCAGG<br>TTCCCAGAAAGTCTGTTGTAACTTAAGTCAACGGTG<br>TGGGAGATGGTTGAAAAATTGTGGTGGGAGGGGAC<br>CAGATAGGAAATTACAGGACAGGTTTAGGAAAGA<br>TAGGGATGTCAGATTTTCAAGAGGGGCATAATAAT<br>CATTGTAATTGGTCGTAGTAAGGCCTCTATTTGGTA<br>AGGAAATCCCGACCACACGGTGACCTTGATCATCA<br>CAACTGATTCCATCCCACAAACAGCAATCTTCTCCT<br>TCCCCATTGGCAGCAGCCCAGTTGACGACGCTGGG<br>AAAGTTGTTGCCAAAAAGCAACAGAGAATCCTTAT<br>CATCAGAGTTACAAGCTGCTGCTGCTGTCGTCCTTG<br>TACAAGCAGGAAACAACAAAACTAACACTAACACT<br>AGTATCATCAACAAACCCCTCCCCACATGATCATGC<br>TCACGATTATGATTGAATGATGAACAACAACACGG<br>GACCAACAGCATCATCAACAACCAAACCAAACCAC<br>ACCACACCACCCACCCACAAACAAACAAAGATATA<br>TATATATATATATATATTACTTTTTGTTTCTAAAAAG<br>AAAGAAGAAAATTATGAAGAGAAAAAGACGACGA<br>TAATGGTAATAATCCCATTTCAATTCAAAGAAAGAA<br>AGAAAAAATACAAGTGGATGTTGACGCAGACCATT<br>AGTAAAAAAAAAAAAAAAGAGAAGGGCATCAAAT<br>CAAATCAAATCAATTGAATAAATTATATAATTAGAA<br>AAAATTACAAATAGAGAGGGTGTTTCTATTCATTTA<br>TCCATTATTATTATTATTATT |
| 41 | Conyza canadensis | Genomic | 9016 | ACACACACATGTATATATATATAGACCAATTCGGTT<br>TTCGAATTGGTTTTGTTTAAAAAGCAACAACTCGTA<br>AATCAAATTATCAAACCATAAACCGAATTTCAAAAT<br>CAATTTGTTGTCAAACCAAACTAAAAACTCAAAAAA<br>ACCAAATGAATTTCAATAAATTTTTATTTCAATTTGG<br>TTTGATAATTGGTTTCATCGACTTGGATCCGTACAC<br>TGAACACCCCTACTTACATGTACTAGTACTTTCTGT<br>AGATTACTTAGCATGTGAACACCTTCATGTTTCACC<br>CATCTGTGAACGTTGTAAACTTAATTTTTGTACAGT<br>TGTATCTGCGATATATACTAGTTTGTGACCCAATAG<br>ATAGATTTATTAATTATCATATAGTTATGTAATTATA<br>TTTCCATGTATTGTTTATTCTATTTCATAATTGTGTA<br>ACAGGTCAGTTTACAAAACTGTACCTGACTGTGAA<br>CCTTGCCGTCCATTACAAAGATCTCCATTAGAGGGA<br>TTCTATTTAGCTGGCGACTACACGAAACAAAAGTAT<br>CTGGCTTCAATGGAGGGTGCTGTTCTATCAGGAAA<br>ATTTTGCGCCCAAGCGATTGTAAAGGTAATGTTAA<br>AGCAACTCGTAGCTGGTAGTTTTAGAATTATTTAGC<br>AAGTGAAAGTATTTTCTCTGCTGCTTTTTAGAGTA<br>GTGCAATTTGCAGCAGACGAATTTTGGGTATGTGT<br>TTATAAGTGACCATAAAAAGACAAAGTAGCCTACA<br>TATTCTGTTGCTCATCTTCTGATGCATCATGTAACAC<br>AGGATTATGAGTTGCTTGCTGCCAGGAGGGAAGT<br>GGTTGCTGAGGCAAGCCTTGTCTAACTGTATAGAT<br>GCAAGATAACTTGGTAAGTTAAAAATCAGTTGAAG<br>ACAAGAGCACGTGGTTCTTTGCATATTTGACTTTTT<br>ATGGTCCTTGGCTGAAGTGGTAGGCTTAAGGAGGT<br>GGCAGAATTTCTGGGAGGAGCTTTTACAAGTTCAG<br>AAGAAGCTAAACATAAATACACCCATAGCAATTCA<br>TTGTTCTAACTGAAACTTATTTCATATTTGTCAAAGA<br>AAAAAATACATATTCCTGTTATGTACATAGTTGGTT<br>ATTTTCCCTTGTTTTATACGTCATGTGTGGCATCGA<br>ATCTATTGATTATCTATACGTATTATATGTGGCATG<br>TTTTTTTTTAATTTTGCATCCTGATCTTTGATTACACT<br>TTTCAAGATTTATTCACTTTGCTTCCATGGCATACAA<br>GAAAACAATATCAATACAGCGAGCTATCTATTATGT<br>AACTTGGGAGATGCAGGTGCATGAGAAGTGCTCA<br>AAACTTCAACTACTTGGTGGGATTAAGTTGAAGTG<br>ACACTAACCCAGGTACCAACCTCATCCCGAAAATCT<br>GTGAATATTTTCTTTTTATTCGTCTTAGTTAAAAAAA<br>GAAAAAAAAGAAACAGATGATGCACCAGTTCAATA<br>CTTTTTGTTCGATACCTTGATTATTTACCAAATGAGA<br>CACACTGTATGTCTGTATGTGCTTTCATCTTGTTTCA<br>TTTTGTGGGAATGTGGAGTAACAGGTATAAGAATA<br>GCAATAACACAAGTCTAGTTGCTGAAGAGTGTGAG<br>CAGAGTAAGATTTTGGTATGATACCAAGTAAAGTA |

TABLE 1-continued

Weed species and PDS gene sequences

| SEQ ID NO | SPECIES | TYPE | LENGTH | SEQ |
|---|---|---|---|---|
| | | | | AATGCGTAGAGAGTAAGGTTTAGGTGATTCCTTAA TGAAATGGGAACCTTGTGATTGTCAATGAGTTATT AATCCATTGAATTTGAAATTTCACAACGTGAAATAA CTTGTGCTCTTACAAAATGTTTTGTGGTCATATATTT ACCAATACATGTGTCTTCTTGGACACTAAAAAAAAT AGATAGCTGGTGAAGATACTATATAATTTAATAATA AGATAAGATAGCGTCTACTTTGCTGAAAAGTCAAA ACTGGATTACCAAATCTCATTCTCACGTGTCAAAAT TTGACAGGATCTTTTGAAATTCACTTGTTGGACATT GGCACTGGATCATGCAAAGGGATCACATTTCTCTTC AAGCCTTATCCCATTCCCAGCTATAGATACCATAAA TATAAACGCTGGAAGTGCAGTATTGAATTACCTGA TTTATGTTTTTGGATGTGGGGGGTTTTAGGAGGTG ATATGTAATCAAAAACTTAACCCAATCCATTCAAAG ATTGTGTGTTGTATATGACCTAAAGAAAGTGAGA GAGAGAGAGATTATTCTTAATTCTAAAGTAATAAAT TGTGAAGGCAAATAAGCCGACAGCATGTTCCTGAT ACACATATCCATCACAACATCCCCTCCCAACTTTGTC ACTTCCATTTTACTCCACACTATATATACGCACACCT CTTTCAACAATGGCTTCTACTGTACAGAACATCCCC ACTTTTTTGAGCTTTTTCACGGTGTCTGCATGAAGT TAAGAGTTTGACATCTGCTCGCATTCACCCCCCCTT TGGCCTTGATTTCTTCCCACATATAACTTCAAACTTA ATTAATGAATTGAATGCGACCCGACTCTTTTCCATG CAAATCAGTGGTCACTTATCAATGTTGATTGTTGAC TCGATCCCATCTATAAATACCCCTTCTTGCCATTTTC TCTCTCAGGGTCCCAGCTCCACATCTGTGAGGCTTT TTTTCTTTTGGTCCCAAATCTTTCAAAAAAACACAAA CAGAAAATGGCAACAGCTTTACAAACAAAGATAGA AGGGAATCGTATTACAACAAAGTGTGCTTCCTTAG TAAAGAAACAGCGAGCTCGTATATATATCCTACGTC GTTGTGCCACCATGCTTCTCTGCTGGTACATTCAAG GAGATGAATAAATAGTTGATGCTATGACACAAACA ACAGACATGTTTTTATCCTCGATTCTTATAGTCTCTA TATCCCTTTTTTCACATCAACTCATGTGGCTCCCGTT TTCGGTTCTTTTCTTTGGCTTATACATATTCTTAAAT ATGCATGCCCTAAACTTCCATCTTTTTAACACCAAC GGTCCGTTGCATTTAAAGGCTGTTAGGTCTTGTCTC ATTTTCTACTCCCTAGTTTTTGTCATGTCTTGTTTATC TTGACCTCTCTTCATTTGTCCTGTTTAAAACACTTTT TTTATCCAAATGGTTTTCATTTGGGTTTTTTGGGCAT CTGCATCAGAGGACAATTTCAACTTTAGACATGGA CCAGAAACGGGGATATGACCAGCATGAAGGAAGC AATCTTGCATCAAGTTGGCAGCTTGAAATGAAGGT TCTACAATAACATCTTGCGTTGTGTCATGGTTTGTA GATAATTGTCTCCGCTGAAAATAAATGACGGTTCCT CACTTCCTTGATATGTAAAGCACTCATAAAATGATT AATAATTCGGTGCTGCTACAAATATATATGTTGAAG CGCACTAAATCTGAAGTTGTGATTTATTCATCGGGA TGTTTTTTTCTTTTTAATAATGACTTTTTCATCATTTA AGTTGACATATACAGCACCCACTAATGCTAATATCT TAAATCTCCACATTTCCCTTGCAATCACCAAGACAA CTTGCTGTTAGCATAACCAGACACTGCTACTAACTT TAACCATCAAAAGCACATAATCCCGCAGGTCTTCAA ATCCAAATGAGGCCGGACATCATAGAACTTGTAAT TTTAACTCACATAGAAGTTTGATAGTGTGATATATG ACAAGGGCAGATGGTAATAAGTAGAGCTAGCAAA TCCTTTTCATATTGTTAATCCTCTCTCAAAATGGACG AGGAAGCTCTAAAACTGCAGAAAACAAACTTTTAC AAACGAATTTAAAGCTTTAAGAGGGAATAAGGAAC AGGCATGTCATTGAAGAATGCTATCTATTTATTATG GAAGATCTGTGACCTTAAAATCCCATAAATATGATA TGTGTCGGATCGTCCAGAATGAAAAGTAGCTCAAG TTGTTAGAAATGTTAAGTAGACACAGATGTTGTAT GGAACTATGGAAGTTCACTTATCTACTGTAATGAG CTTCCATCTCTCCCAATGAATTCCAAAACCCTGACTC ACCTTCAAATTAATTCCAGCTCGTGAACCAAATTTG TGATTCTGGACACCAACCCTTATCAAAGAATTTAAT TAAATTGGCAATTGACTTGAGATGTTTGAAATTCAA TTTTAGAGAATAGAAGTTTCATACAATCAACGAATG AACTTTATTACATCTGTGTATTTTAACAGCGTACGTT TCCTGCTTAACTCGAGTGCTGGATCCAACCCATATC AAAATACGCATGTTACCGGCGCATCTGGTCTAGTCT TATTCCATGGATACATGTTCCGTGTTCCGTTCAGAA GGTTATGTTTCTACCAGAAGACAGTTACAGGTACT |

TABLE 1-continued

Weed species and PDS gene sequences

| SEQ ID NO | SPECIES | TYPE | LENGTH | SEQ |
|---|---|---|---|---|

GGTTAACAAGTCTATTGTAAATCATATACTTTTACA
ATGGCATTGATGTATCTGTTAACATAGTGGAAGAT
GCGGTACAAAGGAATATGAACAGGCTTCTTTGTGA
AAGATGTATCTATTCAACAGCCAGCCATAGCTGGA
AAAAGTGTCTCTATAGTCTATATACATTAATGCACG
GTCATCAGGTAAAAATTCCTTTGCAAAAAGGAACC
ACAAACAAAAAGCAAAGGCGAGTAAAAAAAAAAA
AAGAACCTAAGTGAGAGATTGCCTGCACAGACAAC
TAATTACAATGTACATTGACTCGCACACTTCGCAAT
GACACAATACTCTGATTTCTATATATATGTGTATGT
GCATTTACATTTGCCCTTTATTTTGGTATCCGATGGT
TGGGCCCAACATTATGGAGCCAATCAACCACTTCAT
TAATGGTTGGCCTCTTGACGGGGTTTACGTTCACAC
ACATACAGGCGACATCAAGAACCTGCAGCATCTCT
TCTTCAAATCCCTTGTCTCTCAGGATCTCATCAAATA
TTTGATCCTGTTTCCCTTCTATTCTAAGTTGTTGCAC
CCACACAACCAATTCTCTAGACGCCTTTGGCCGGAA
TACCTCCATGGGCCTCTTTCCTGTAAGCAGCTCAAG
CATGACAACCCCAAAACTGTATATGTCCCCTCTCAA
GGTGGCTATCCATGACTGGCTGTACTCCGGTGGAA
TATACCCCAGGGTGCCCACCAACTCAGTCGTGACG
TGTGTATTGTATGGATGAATCAATCTAGACAATCCA
AAATCGGCCACGTATGCTTCAAATTGGTCATCCAG
AAGGATGTTACTTGATTTGATGTCACGATGCACGA
TATGTGGTTCGCATACTTGGTGCATATAAGCCAGTC
CACAACTTGCTCCCCGGGCGATCTTCAATCTCGTTG
GCCAATCGAGCCTGGATGCTCCGTCAGCCTTCTCAT
GTAGCCAGTAGTCCAAGCTTCCATTTTCCATATACG
AATAAATCAGCAGCTGACATCCATCATGTACACAGT
ACCCTTGTAAAGAAACCAGATTTTTGTGATGGGCA
GTTGATAATGCCTCCACTTCTGCTTTAAACTCCCTTG
CAATGAGGCCCATATCTCCTGAAAGTTTCTTGACAG
CCAGTTTTGTTCCGTTCGCCAAAGTTGCTTTGTAAA
CCAATCCAAAGCCCCCACATCCAATGATGTTTGCTT
GACTGAAATCTTCGGTTGCTTTCAAAATATCAGTTA
TGGTTAGATGTTTGATGTCTTTTGCATTGTGCGGGA
ACAATATGACTCCGCTGGTATCCTTGGGAACCTCTA
CGGCCGACGTAGAATTGAAGGACACCGTGTCCATA
TGGAAGACTTCCGGGTCACCTCTGGGGAGAATCCT
TCTTTTGGACAATATCCACAGTGCCAGACAAGCCA
GAGTGATGCCAACCCCAAAACAGATGCCCAGGATG
AGGCCGACGATGAGTTTCTTGTTTGGGCCTTTTTCA
TGTGGCGAGGAAGCGTCTGTTTTGGGTGATAGAG
GATTATTTTCATCGTTGCAAAGGTTTTGCATGGGTG
GACCGCACAACCCTGGATTGCCTTCGTAGTTCTGGT
TCAAGAAGGTGTCAAACTGTCCCCCGGTCGGTATG
GAACCTTGTAGCTTGTTGTAAGCGACGTTGAAAGA
AGACAGAAAGTGCAAGCTTTTGAGGGAGGCAGGG
ATCTGACCAGACAGATTGTTATGGGAGAGGTCCAG
CTTTTCCAAGTTTGTGAGATTTGAAATGGTAGCGG
GAATGGAGCCAGAGAAATTGTTTAGGCTGAGATCA
AGTGTATGAATGGACTGCATATTACCAATCTCAACA
GGTAGGCTGCCACCGAGTTGATTGCTTGACAGGTA
CAATGCTGGAGGCAGGGTGGCCAGCTGATTGTACT
GCAAATAGGATGCATTTTGAGGGGCAACGAATACA
GGGAGTTCCAGGTAACTGCTGTTTACACGGTCCAA
AACCTGCTGCGATGCGAGGGCTGGGAGTCTGGTA
AGCTCCACAGGGAATCCCCCGGATAGAGAATTATT
AGACAGGTCCAGATAGAAGAGGTTCGGAAGCGTG
TGTAGCCAGCCCGGAATGACGCCGTCGATATTATT
CTGGGAGAGGTCGATGACCTCCAGATTGGTAAGG
GAAGAGAGCCACGTGGGGATCTGACCGAACAGCT
TGCAGCCACCAAGACCCATGATCTTGAGATTGGAG
AAACCAGAGATGGGTTGAGGGGGAGGGGTTCGT
TGAAGAAGTTCTTGGAGAGGATGAGGGTGGTGAG
TTTCGGATGCCTGCTCAGGATATTGAATGCGCTTGT
GATGTTCCTGAGGGTGTTGTTTGAAAGGGAGAGG
AAGGAGAGCAGGCAGGCCGAGGACATGAGCG
GGGATTTCCCCTCGCAGCCTGTTGGTGGCCAGCCG
GATTGCGGTGAGCGATTTGCAAGAGAAGACGGTG
GCCGGCAGCTCCCCTGCGAATCGGTTTTCGCCAAG
GTCAAGGATGGTGAGCCTGGTGAAACCGGAGAAA
TCAAAATCCGAGAGAATGCCGGTGAAGGAGTTGA
CCCTGAGATTGAGAAGCTGCAGGGATTTGCAGTTG
ACGAGGGAAGGAGGAAGGGTTCCATTGAGACGGT

TABLE 1-continued

Weed species and PDS gene sequences

| SEQ ID NO | SPECIES | TYPE | LENGTH | SEQ |
|---|---|---|---|---|
| | | | | TGATGTGAAGTTCAAGTTTCTGCAACAAGGGGAGG |
| | | | | TTGCCAATGGCGTGGGGGATGGGCCCGCTAAAGTT |
| | | | | GTTGCCAAACAAGGCAAGAGTGGTGAGGTTGGTG |
| | | | | AGGGTGGTGATGGAATCGGGAATGGGGCCGGTGA |
| | | | | GAGAGTTCCCAGGGAACGATAGATGGCGGAGGGA |
| | | | | AGGGGTGGTGGAAACGTGGAAAGGGGCAAGGGC |
| | | | | GCCGGTGAGGTTGTTAAACCCCAGACTCAAAACCT |
| | | | | GGAGGGAAGCACAGGGGCCCGACAAAGGGGGGA |
| | | | | AATCCCCGGTGAAGTCGTTCAAGGAGAGATCGAG |
| | | | | GATGGTCAGATTAGAGTTGCATATGGTGGAGGTG |
| | | | | GGGACGGGGCCTGTCAAGGTGTTGTTGCTGACATT |
| | | | | GAGGGCAATCAAAGAAGGGAAAGAAGGGAAGAA |
| | | | | GGTAGGCGGAATCGTGCCATTCAGATAATTACTGG |
| | | | | ACAGATTCAGGGTGGAGATGGTGGTCGTGGTGGG |
| | | | | TTGTGGCAGGTTCCCAGAAAGTCTGTTGTAACTTAA |
| | | | | GTCAACGGTGTGGAGATGGTTGAAAAATTGTGGT |
| | | | | GGGAGGGGACCAGATAGGAAATTACAGGACAGGT |
| | | | | TTAGGAAAGATAGGGATGTCAGATTTTCAAGAGG |
| | | | | GGCATAATAATCATTGTAATTGGTCGTAGTAAGGC |
| | | | | CTCTATTTGGTAAGGAAATCCCGACCACACGGTGA |
| | | | | CCTTGATCATCACAACTGATTCCATCCCACAAACAG |
| | | | | CAATCTTCTCCTTCCCCATTGGCAGCAGCCCAGTTG |
| | | | | ACGACGCTGGGAAAGTTGTTGCCAAAAAGCAACA |
| | | | | GAGAATCCTTATCATCAGAGTTACAAGCTGCTGCT |
| | | | | GCTGTCGTCCTTGTACAAGCAGGAAACAACAAAAC |
| | | | | TAACACTAACACTAGTATCATCAACAAACCCCTCCC |
| | | | | CACATGATCATGCTCACGATTATGATTGAATGATGA |
| | | | | ACAACAACACGGGACCAACAGCATCATCAACAACC |
| | | | | AAACCAAACCACACCACACCACCCACCCACAAACA |
| | | | | AACAAAGATATATATATATATATATATATATATATA |
| | | | | TTACTTTTTGTTTCTAAAAAGAAAGAAGAAAATTAT |
| | | | | GAAGAGAAAAAGACGACGATAATGGTAATAATCC |
| | | | | CATTTCAATTCAAAGAAAGAAAGAAAAAATACAAG |
| | | | | TGGATGTTGACGCAGACCATTAGTAAAAAAAAAA |
| | | | | AAAGAGAAGGGCATCAAATCAAATCAAATCAATTG |
| | | | | AATAAATTATATAATTAGAAAAAATTACAAATAGA |
| | | | | GAGGGTGTTTCTATTCATTTATCCATTATTATTATTA |
| | | | | TTATTATTATTATTATTATATTATTACTACTTGCTACT |
| | | | | ATTCTATTTTAATTACATTATTATTATTAATTATGTAT |
| | | | | GATATAATGAGAGAGTTGAAGAACAACTAGATATT |
| | | | | AATCAAATCCATCCATCCATCCATCATGACGACGAC |
| | | | | CAATAGAGAGAGAGAGAGCGCGCGTTTACTTT |
| | | | | GTTTATTTTATATGAGTAGTAAGTATTTGATGTTTTT |
| | | | | ATTTTAATCAAGGAAATTACTGTAATTAAATTCAAT |
| | | | | TGACTTGAATTGGTGGAAGGAGGGAGGGTGGGG |
| | | | | GCGGCTGTTCGCTCATCAGTCATCACCATCCATCTC |
| | | | | TCATCGTGTCATGATGTATATATATATTATATATA |
| | | | | TATAGAGAGAGAGGGAGATTAATAAAATACAA |
| | | | | ATGGACAAATGCAAATGGGAATTATTATTATTATTA |
| | | | | TTATTTATTTAGCTTTATATGGATATGGAAATGGAT |
| | | | | GGTGTGGGCATCTCATCAAATCAAATAGAATCCAA |
| | | | | CCATTACAAGTGCGCCTTTTTCCTTTTCTTTCTAAAG |
| | | | | TGGAGAGACGGATTGAGTGAGGGAGGGACTATTA |
| | | | | CCAATACCAATTATACCATGGTTAGTGGCGGTGGT |
| | | | | GGTACGACTATTACCAAAACTAATTATACCATCAAT |
| | | | | ATATAATCACTAATATATATATATATATATGGTA |
| | | | | ACACTCCGATAAGAACACTTTTAAAATAAGAACGG |
| | | | | TGAAAACACCTTAAAAACATCATTTTGAT |
| 42 | Conyza canadensis | Genomic | 8264 | TTAAAGATATTTTCCTCCCACTTTTGGGATAATTTG |
| | | | | GAAGGAAGGAAACTCCACTCCTTCTCTTCTTTCCCC |
| | | | | TTCCTTTACATATAAACTCGAGAACACAGGCTAAGG |
| | | | | TTCAAGTTTCAAGTCTTACATTTGATTACTAGCCAA |
| | | | | AACATTAATTAGTTATTGTTATGCAAAAAAAAAAAA |
| | | | | AAAAAATTATAAAAATTGAATTGATTGTTAATCAAT |
| | | | | ATCATTTTATGTTGAGTTATTTGTTTTAGTATTATAT |
| | | | | TAAAAGTAAAATAATGCTACATGAATTTTTCTTTTTT |
| | | | | TCTTTCTTAAGCATTCAATGCGATTTTAATTAAAATA |
| | | | | AAATAAAATAGACTATCATTTGTAGCTAATTATGTA |
| | | | | ACATATCAACTATGTTTTATACAATACTAGCATTATA |
| | | | | TTCGTGCGATGCGGCGGTGGTCGTGACGACGAAA |
| | | | | GTGTGGTGGTGGAGGCGAGTGTTGGTGGTGAATG |
| | | | | CGACGTCGAGTGCCGTAGATAATTCATATAAAAGT |
| | | | | AATTGATTTAAAAGGTTAATGGAGATATTTTAGAA |
| | | | | AAATAAAGGATTGATAGTGTAATTTAATTATTAATA |

TABLE 1-continued

Weed species and PDS gene sequences

| SEQ ID NO | SPECIES | TYPE | LENGTH | SEQ |
|---|---|---|---|---|
| | | | | TTAAGAGAATAGTGTATGTGAAAATCTTTTAAAGG
TTTGTAGGCTTGTAGCCTTGTAGGTGAAAATATTAC
ATAGGAGGGCATTTTAGACATTTCCCCATGTAACTT
TCAACATGGAGGGTATTTTCTTTAATATAGAGTATA
AATAATGGAGATATTTAAAAAAAATAAAGGACTGA
TAGTGTAATTTAATTATTAATATTAAGAAAATAGTG
TATGTGAAAATATTTTAAAGGGTTGTAGGCTTGTA
GCCTTGTAGGTGAAAATATTACATAGGAGGACATT
TTAGACATTTCCCCCATGTAACTTTCAACATGGGGG
GTATTTTCTTTAATATAGAGTATAAATATAGATAAA
TAATATATATTTTGTAAATTTTTTAAACTAATAAATT
ATTTTAAAATAATAATTTTTATAAAATATATTTTATT
TGATAAATAATAACTCTAAATTACACAGATGGTACC
TATAATTTGTATTATATTACATGTTTCATACCTCACA
TGCAAGACACGTTGGCTACTTAATGATACAACTAAC
GACCGTCAGCGTGAGGTATCTTCTAAGTGTAAAAT
TATAAACATGATATAATTGACGTAATTTAAATCTAA
CAGGTATGAAATTAATAATTTCGACCAAACCAAAG
GTACTTAATTCACTCTTAATATACTGTATCTAATACT
ACTCGTGGTAGTATTATGTAGATTCCTAGCAATGG
ACGACAATATTCCAACAACATAAGAAGCCAAAACC
CACTTCCTTCCTTTTTTTTTTTGTTGTTGAATAATTTA
ATCAGTTTTTAGGAACGAACAACCTCCTCCATTTCC
AGATAAATTATTATTCAGCCAAGCAAAAAACACAA
CATCCCTTGTTTCCTCTTCTTCTTGTTTTCTTTTTCTTT
CTTTTTGCTAAAAAACTCACACACGCAGAAGAAGA
AGACGAAGACAAAGTCAGAGAGTTGAGTTTGGAC
TGATTGATTGATTTGTTATTAAGGTAAAAATACCAC
TTACTACTCCATCCATCCATCCATCCATAGTAGACT
GGTAGTTGTATTAGTAGTAGTTAGCTGCTGCTTTGG
TTATTAGGATTAGGATGAAGAAACTAGCAGATTGT
TAAGTATTCTTCATGTGACTTTGTTATCTTCCTTTGT
AAACAATCTCCCCCAAATATAATAGCATATCGACTA
AGTGGTAATATACTTATTTTTTTTTAAGTTGATGGT
GAACTATTGTATATGGCAGGGCTGGTGTTTGTCTG
ATCATCTGCAGCGAGCTGATAGTATTATTATTATGT
CTCTTTTTGGAAATGTCTCTGCCATTAACCTAACTG
GAAACTGTCTGCTATCAATCACTAGTTCCAGAGATG
TTTTGTCATTTCGGCACGGTGATACTATGGGTTATC
GCTTGCAATCCCCCCCTTCTTTTATTACCAAAACTAA
CAAAAATGTCTCCCCTTTGAAGGTACAACCTCTGCC
ACATGTATTTCATTATCACTCACAAAATCAATTCTAA
TGTCTTTGTTTATCTGTGCTAAACAGGTAGTTTGTG
TCGACTATCCAAGACCAGACCTCGATAACACCTCTA
ATTTCTTGGAAGCTGCTTATTTGTCTTCTACCTTCCG
AGCTTCTCCACGCCCACCTAAGCCATTGAAGGTTGT
AATTGCTGGTGCAGGTAAAACCTTCATACGTCATTA
TATTGTCTTTTAAGTCGCTTTTGTTTGAGAATTTGAT
ACTGCCACATCTGATAGATAACCAAATGATACTTCT
AGTGTATCCCCAATGATGCTTTTTATGCCACATACT
AACATCTGCTTTAATTTGCTATCCCACTTACTTTTGC
AAACTTCGCATATGCAGGTCTCGCTGGTTTATCAAC
TGCAAAGTACTTGGCTGATGCCGGTCACAAGCCAA
TTTTGCTAGAAGCAAGAGATGTTCTTGGTGGAAAG
GTAAACGATTTATAAGAAATTACAATAGGATCGGA
AGTCCTAGGATCCCCCCTCCCTCTTACCTTCTTCTAT
ATAACAGAGCAAGCTTGGTAATAAAACAAGGATTT
TGGGTCTAATTATTCTCTTCTTTTACTTGCTTTCTGTTT
TCGTCTCTTTCACTGATAACCAAAGGCAATATCAGT
TAGGGTTCTAGGATGGGTCGAAGCAAATTTTAGGG
ATACCAATGCCTAACCAAGTTCGATCAAGACTAGG
GATATAGAGGGTATTCAATCAGCTTCTGGTGGGAT
TATAGCTCGCGACTTTGAAGCTAGAGTTAGGGTTC
TTTAAAGCCTAACATAGTTCAAATACGGCTGGGGT
GTTGGGGGTTCCTTTCTGTACGAATTTAAAGCTGG
ACAAGGCAGCAAAAGAGTTCGACTTGTGTGGATTT
TTATCTAGGTTTGGCTGGGGTTTCAAACAACCGAA
GGTGTGTTTGGGGTTCTTGGGATAGTCGATCAACA
TTGGAGTGTCTTTTTCCTGTTTTACAAGTTAGAATA
CGTGAAATGCATCTTCGTTCATTATTTTGCTTTTGAC
CTTTATGTGATGGGTACAAGTTTAACAACCTACTGC
ATGCGGTTTCTCTTTGTGCTCACATTTCACTTTCTCT
CTTTTCTCTTTTGCATTGTTGGGGTGGGATGGCTGT
TTTTGCTAGTAACATTTATACAAACCTGGACCTAAT
GTTAGGTCAATCCGGGCTGGGTTCACAACTGGATG |

TABLE 1-continued

Weed species and PDS gene sequences

| SEQ ID NO | SPECIES | TYPE | LENGTH | SEQ |
|---|---|---|---|---|
| | | | | GAGGAATAAGGGTCGGAGGGAAATATTGAATGGC TCCTCAAACCCAAAGTAACCCAGATCCAAACACTTC CAATCTAAACAACCCAGACCCCGTGGCTGCTCAATC AACAGCCATAGCATCATCTATGAAATCACTGCAGC AAAGAGGTAGCAATGATCAAGCACAGTAAGCCA AACAAAAACAGAAATCAAGCGGCAATTTAAATCAA TTTGAAGATGAAGGTTCATCTGGTGGTAACCACCG TCACTACAGACCTTATAATAATATCGATTTCCCAACT TTTAGTATTGGAGAACTGTTTACAAGGCTATGAGT ATTGCTATCGAGTTTGAATCCAAGGTTCACATGAAA TTTAGGAAAAGTTTTTCGTCTTCAGCCAAAACAGAA TCAGTACCTTCGAAACCAATAGAAACTTCCAACCTG TTGCCCTCGATTGCTGCTGCCCAGAAACCAACTGAA GCCCGTCTTTTTGATGTTAAAAAATAGGGCAGATTC ATACGAGAAGTTGTGTCTAAGTTTCTGATCTACTCA AAATTTCTATCAATTTGCCTTGGGGGAAAGCCGAT GTGGTACTCGGTATTCAATAATTAGGAACACTTACA AAGTTTAGGCAAAATGGAAGGAGATAGTCATGAA GTTCACTATGGATGTTAAGGAGTACAAGCTACATG GACTTCCACCAGATCGTCAACCATCAGCAACATTTA GCGACCTCACTACTGAACCATTCGAGTTACAGGCA AGTGGACTAGCAGCTCATTTTTTCACAACTGGCTAG TGGACAAGTCAGATTTTGGGGCCGGATGTATTGAT ACAAACCTGGACCCAATGTTGGGTCAAACCAGGTC GGGTCAGCAGCTGGATGGAGGGAAAAGGGGTGG AGGGAAATCAAGTAGTGAAGGAATTCAAGTTAGG AAGTGGACCATGCGCCCACTACATATAATTGCTCCA CTAATTTTAGTATTATATATGTGTGTTTTTCTGTTTT TTAAGCTGGTCAAGATACTAAGTTTGTGATTGTTCT TGTATTCGGAGATTTGCCATCTGAATTTTGCTAATA TTGTGTTAGACTCAGTAATCTAAATTAGTAGATTTC CAGTTTCTATCAAATGTTCGTTTGGTGAAAATGAAT AATTGAAGTTCATATGACGACCTTATTTGAGCAGG ATCTGTTCTATAGGCTCGTACCTCTGTATCCTTGATT CCTATCAAGACAGAAAGTAGTTTCATATGAAATTT CTATTTTTAAACTTTTGTATATCATAAGTAGTCAAGC TTAGCTTAATTTCAAATCTAGGTTGTCTTAGTATGTT GTTACTTATCGTGAGTGTTTTTATCCACATTGCTCTT CTCACATAGGTAGCTGCCTGGAAAGATGATGATGG AGATTGGTACGAGACTGGTTTACACATATTTTGTAA GTTTTAACTTCTTATATCCTTTCAAGTGTCGAAAAA GAGAGCTGATGTGTGCATAAAAAGTTATTCCCATA ATATAATTCTCAACAGGGTTGTTGTCGTCTTTTTGT GCACTATCTATCTGCTCTAAGTTATTGTTTCTCCACG TACCTTTCCTTTTGGACATTTGTCACTAGACACCTAA TGTGCAATAAACTTCTTCATTTGCTTGAAGTTGGAG CTTACCCGAATATACAGAATCTGTTTGGAGAGTTA GGCATTAGTGATAGATTGCAGTGGAAGGAGCATTC AATGATATTTGCGATGCCAAACAAACCTGGAGAAT TTAGTCGGTTTGATTTCCCAGATGTTCTGCCGGCAC CATTGAATGGTAAGTATGCTATTATTAGCCTATTTT TTTTGGTGTATATATTTTATTTAAATGATTTGGTGGT GAGCATTTTCTGCATCACCAACATGACAAAAAAGA TCTAAAACAAGATCAGTCAGGGAATGCTAGATTAC TAACAAATGTGACTCTGCATACCATCTCAGGAATTT GGGCTATCTTGAGGAACAATGAAATGCTGACATGG CCTGAGAAAGTAAAATTTGCTATCGGGCTCTTGCCT GCAATGTTAGGTGGACAGGCTTATGTTGAGGCACA AGATGGTCTGAGTGTTCAAGACTGGATGAGACAAC GGGTATGTAGTCGTTTATGTAAATATTTCTTTTACC ATTTTTTAGTTTAATACATAAGAAACAATGGCCATG ATACCTGGTATATTTGATAATGGTAACGTTTCTAAG TGGAAGATCCAGAGGTCAAACCTTAGCAGGGGCTT TTTTTAGGAAGATTGTTGGCTAATTAAACCCCCTGC TTAATAATTCGAGTTCTTGTTTCTTTTGTTATGAATT TTATTTAATAATTAATGCACATTTTTCATTTTTCCAG GGCATACCAGATCGAGTTACTACAGAGGTGTTTAT TGCCATGTCAAAGGCATTAAACTTCATCAATCCAGA TGAACTTTCAATGCAATGTATTCTGATTGCTCTGAA CCGATTTCTTCAGGTGAAGGCATCATTCTCTTAGAG CTTACTGGTTAAATAATGATGAAAAATTAATCTCAT GACTTTTAATTCCATCTTCCGTCTGTCATATATGATA AGTTGGTCACGGACTCAAGTCACTAATATATTATAT GGATTGATTTTACGCTTGTGATTGGTCAAGTAGAC AAAGCATGCAAAGTTATATGGGTTTAGTGTAATTA |

TABLE 1-continued

Weed species and PDS gene sequences

| SEQ ID NO | SPECIES | TYPE | LENGTH | SEQ |
|---|---|---|---|---|
| | | | | GTGTCTGTTGCATTGCTCACTGTATGTCTGTATTGG<br>TTGCTATAAGCCAGCGTGCTACCTTGAAAGCAACTC<br>TATTTCCTTTTCCATGATCAAGTATTATTACATATAT<br>ATTGTGCTTCTAGAATCCAGATACAGAGATTTGGG<br>TTATTTTTGTGGTTTTGAAATAGGAGGGCGGCCTCT<br>ATAGTTAATCTCGAAGTGCTTATTGTACACCATGGA<br>TTTTTGAAACAAAGAGTTGATCGCTCTTATCTGTAG<br>CTTCTTAACACTTCAATATTGGCTTGGTTGCAATACT<br>ACATGGCATAGACATTGGACACCATAGATAATACA<br>ACTTGTAAATTGTTTGTAATAAATCAACAGGAGAA<br>GCATGGTTCTAAGATGGCATTTTTAGATGGCAGCC<br>CACCTGAAAGACTTTGCATGCCAATTGTTGAGCATA<br>TTGAGTCACTAGGTGGCCAAGTCAGGCTTAATTCG<br>CGAATACAAAAGATCGAGTTGAACAAAGATGGAA<br>CAGTTAGGAACTTTTTACTTTATGATGGAAATATTA<br>TTGAAGGTGATGCTTATGTATTTGCTACTCCAGGTA<br>CATTTAGAGAACGACTATTTGAATCTGTAGCTTTCA<br>CATGTCTGTTGGGGTTGTAGCTTTATTGATTATTTT<br>GTGTCAAACAGTTGATATTCTGAAGCTTCTGTTGCC<br>TGAAGATTGGAAAGCAATTCCTTACTTCAAGAAGT<br>TGGATAAATTAGTTGGTGTCCCAGTTATAAACGTTC<br>ATATATGGTTAGTTGGATCCTTCAATATAATTCTAA<br>ACATGGCACAGTAATCATTCACCTTAATTTAATAGA<br>GTCTGGCTTCTGTCTTGACCATTAATCTGACTTAGT<br>AAAACCCCTATATGTATTCTTTGTAATTGTTAAACA<br>CCACTTTCAGGTTTGACAGGAAACTCAAAAACACCT<br>ATGATCACCTACTCTTCAGCAGGTCACCTCTCAACT<br>CTTATTCTTGCAACACTATTACTTAATTTTTAGTAGA<br>CAAGGCTGTTGAGCTTTTTATTTGTATGTTATTCAT<br>GCCACTGCTACCTAAACGGATCTTTTACTTCCATTTC<br>AAATGTCTGGGGCGTGTCGTCCATAAAGGTTCTCT<br>ACAGTTCATAGAGTAACTTAGAGTAAGCTTACACCC<br>CACCTATTAACTAAACAAAGCAACACACAAGTTAGGC<br>TATATGGTACATGCTAAAGTGATGGTCAAGATTGC<br>ACCATTTGCTACCGCCTTGAGATACCAGTGTCCCAG<br>CTTCTGCTTACACTTCATAGTTTATACTCAAATTTAA<br>TATTGGTACAAAAAAGAGTACTGAACCTATCAGTTT<br>AGTCTTTTGTATTAATTATTTAGTTTGCATGCAGGA<br>GCCCTCTTCTCAGTGTATATGCCGACATGTCTGTAA<br>CATGCAAGGTAAAGACAAGCAAACATATATGAAA<br>CAAACCATTTTCTTCCAGACAAACCTGCTTTGCTGTT<br>TTCATATGGTTCCTTGTCATGCAAACAATGAGGAG<br>ATGGATGTCTATTGGCCTCTCCTCTCATTCCTATTTT<br>CCCGGAAAATGGGTTAAATCTGTCTTTGTAATTTTA<br>TCTTTGTCGCATGCATGGGACATAACTTCTCACAAT<br>GCACATAACTCAAATATTTACCAAAACCTCCCGCAT<br>TTTTAAAACCAGGCTATATATAAGTTGTAAATTACA<br>TGATGTGAACCCATACCTCCCATCAAGGTTGTTCTG<br>ATAATAGTGCTCCCATTTTATACAGGAATACTATGA<br>TCCTAACCGGTCCATGTTAGAGTTGGTTTTTGCACC<br>TGCAGAAGAATGGATTTCACGCAGTGACTCTGATA<br>TTATTGACGCTACGATGAGTGAACTTTCAAGACTAT<br>TTCCGGATGAAATTGCAGCAGATCAGAGCAAAGCA<br>AAAATATTGAAATACCATGTAGTTAAAACCCCAAG<br>GTTAGAAATATCTTACCAGTAAGGGGTTTTCAACG<br>ATTCGGTTTACGAGCTCTTCGCTTTGGTTTCCTTGAT<br>TTGACAATCCTTGAAGCTCAAACCAAAAACCAAATC<br>AAACCGAATTAATCAGAAACAAGCCAAACCAAATA<br>AGATGGTTTGGTTTTGGTTCGAATGCGATTGAAAC<br>CAAACCATTTTCAAATAATGCAGATTTTATGCTGGC<br>AAATGTTATCTAAACTTTTTGGCAAATGAAAATTTG<br>CTGAGATTCATTTACCACCAAAAACTTACTATATGA<br>AAAGAAATATATAATGTATTATAAACTTACATTATA<br>AGTTATTTTAAATTAATTTGATAGGAAATATATATA<br>TATATATATACACACACATGTATATAT |
| 43 | Conyza canadensis | Genomic | 667 | TTATTATTATTATTATATTATTACTACTTGCTACTATT<br>CTATTTTAATTACATTATTATTATTAATTATGTATGA<br>TATAATGAGAGAGTTGAAGAACAACTAGATATTAA<br>TCAAATCCATCCATCCATCCATCATGACGACGACCA<br>ATAGAGAGAGAGAGAGCGCGCGTTTACTTTGTT<br>TATTTTATATGAGTAGTAAGTATTTGATGTTTTTATT<br>TTAATCAAGGAAATTACTGTAATTAAATTCAATTGA<br>CTTGAATTGGTGGAAGGAGGGAGGGTGGGGGCG<br>GCTGTTCGCTCATCAGTCATCACCATCCATCTCTCAT |

TABLE 1-continued

Weed species and PDS gene sequences

| SEQ ID NO | SPECIES | TYPE | LENGTH | SEQ |
|---|---|---|---|---|
| | | | | CGTGTCATGATGTATATATATATATTATATATATAT<br>AGAGAGAGAGAGGGAGATTAATAAAATACAAATG<br>GACAAATGCAAATGGGAATTATTATTATTATTATTA<br>TTTATTTAGCTTTATATGGATATGGAAATGGATGGT<br>GTGGGCATCTCATCAAATCAAATAGAATCCAACCAT<br>TACAAGTGCGCCTTTTTCCTTTTCTTTCTAAAGTGGA<br>GAGACGGATTGAGTGAGGGAGGGACTATTACCAA<br>TACCAATTATACCATGGTTAGTGGCGGTGGTGGTA<br>CGACTATTACCAAAACTAATTATACCATCAATATCA<br>TCACTAATATATATATATATA |
| 44 | Conyza canadensis | Genomic | 97 | TGTGGTGGTGGAGGCGAGTGTTGGTGGTGGATGC<br>GACGTCGAGTGCCGTAGATAATTCATATAAAAGTN<br>NNTGATTTAAAAGGTTAATGGAGATATT |
| 45 | Conyza canadensis | Genomic | 33 | TTTATTTGAGAGAAGAAGAGAAAAGAAGGGAAA |
| 46 | Euphorbia heterophylla | cDNA | 484 | GGCAGAAGTCCCCTTCTTAGTGTTTATGCTGACATG<br>TCTCTTACATGCAAGGAATATTATAATCCAAATCAA<br>TCAATGCTGGAGTTGGTATTTGCACCTGCAGAAGA<br>ATGGATCTCACGCACGGACACCGAGATCATAGATG<br>CCACTATGAAAGAACTCGCAAAACTCTTTCCCGATG<br>AAATAGCTGCAGACCAAAGCAAAGCCAAAATTCTC<br>AAGTATCATGTTGTAAAGACTCCCCGGTCGGTTTAC<br>AAGACTATCCCAAACTGTGAACCATGCCGCCCTTTG<br>CAAAGATCACCCGTGGAGGGGTTCTATTTAGCCGG<br>TGACTACACAAAGCAGAAGTATTTGGCTTCAATGG<br>AGGGTGCTGTCCTATCTGGCAAGTTTTGCGCTCAA<br>GCCATTGTACAGGATTATGAGTTGCTTGCTGCTCG<br>GGAGCAGACAAAATTGGCTGAGGCAACCGTTAGTT<br>AACAATGTAAATACTGTTTAAGGT |
| 47 | Euphorbia heterophylla | cDNA | 347 | TATTGGACTTTTGCCAGCAATGCTTGGTGGACAGG<br>CATATGTTGAGGCTCAAGATGGTTTGAGTGTTCAA<br>GAGTGGATGAGAAAGCAGGGTGTTCCTGATCGAG<br>TCACTAAAGAGGTGTTCATTGCCATGTCAAAGGCA<br>CTAAACTTTATTAACCCTGATGAGCTTTCAATGCAA<br>TGTATATTGATAGCATTGAACAGATTCTTCAGGAA<br>AAGCATGGTTCTAAGATGGCTTTCTTGGATGGAAA<br>TCCCCCAGAGAGGCTTTGCAAGCCAATTGTTGATC<br>ACATTCAGTCCTTGGGTGGTGAAGTACGGCTAAAT<br>TCACGAATAAAAAATTGATTTAAATAATGAT |
| 48 | Euphorbia heterophylla | Genomic | 5622 | AATGTTTATGGAAGGGAAAAAATGTGAAATATTCT<br>GACAGACAACTAAAATTCAATACCAATCATAAAAA<br>ATTTAATGAATGATTGAGATTGACCGAAATTTACAA<br>ATGTATCAAAGTTCAAATTTAGAGAATCCTTTTACA<br>AACTCTTATACAAGTCACAAATTGTTAGGATGAAAA<br>ATTATGACTTCAAACATCAATCGATACATTTAAAAA<br>ATTATCACTCACATCATCAATCTATACATGTATGAA<br>ATGGAAAAATATCACTCCTTATGTTAACCGATACAA<br>CTTCACAGTGGTTGTTATATGAAAAGATACCTTTGA<br>AGCTCAATTTAAGAGTAACCGGTAATCCTTGCTGG<br>CAGAATATTCTCAACGGAGACCATACAAAATCCAA<br>CGCTCAATAATCCAAAAATCCATTTCCACTTTTCCG<br>ACCTACTCCTCTTCCTCTTTGTTATCTTCTTCTTCGTC<br>TTGCAATTTCCAATTTCTTTGTTTCCAATTTCTGAGT<br>TCACTGATTTCTGCCCTCTTCTTCTTCTTCTTCTTCTT<br>CTTCTTCAATTGATTTTGAGCTTCAATTGATATATTA<br>CTATGACACTTTATGGGGCGTTTCTCCATTGAACT<br>TGACCTTTCATTCTGATATCTCAGAAGCTAGAAATT<br>TGCTATCCTCTTTCAGATGTCAAAATCATCTGCTCTC<br>TTTTAAAAGCAGCGAATCTTTGGGTTCTCCTCTGAG<br>AACTTCTATTGGAAATGCTACCAAAACACGATCAA<br>GGACTGCTGGTTCGTCTTTGAAGGTTCGATTTATTC<br>TTTTTCGTATCTTTCGCCCTCGTTTTTCCTTTGTTCTT<br>GTTACAGTATGTTGCCTACTTGATTGATGATACAG<br>GTGGTTTGTGTGGACTACCCTAGACCTGATATTGAC<br>AATACTGCAAATTTCTCGAAGCTGCTTACTTGTCTT<br>CAACCTTTCGTGCTTCTCCTCGTCCGGATAAACCTTT<br>GAAGGTTGTAATTGCCGGTGCAGGTGATCAATTTC<br>TTATCCTAATTGGTTTTCTTGCTTATTTCAGTTCAGT<br>GCTTTTTGAAGTATGCTTGCTTCAATTTGATTTATG<br>GGTAGGCAGGGACTACAATTGATTGATTTTTATTTT |

TABLE 1-continued

Weed species and PDS gene sequences

| SEQ ID NO | SPECIES | TYPE | LENGTH | SEQ |
|---|---|---|---|---|
| | | | | AGTTTTAGCGTTTAAACATTTTATTTCTGGAAGCTG
TTGTCCAAGTCAATAACTTAGCATCTTGAATAAAAT
CTGCAAACTTTTGTGGTTATTTATATACCTCTTCTGA
TTTGGTTACAATGGATTAACAACTTTTACATCATGC
TGCAGGGTTGGCTGGTTTATCAACGGCAAAATATT
TAGCAGATGCAGGGCACAAGCCTTTATTACTTGAA
GCAAGAGATGTTCTTGGAGGAAAGGTTATGCTTTA
CCTAGACTTCAAGAAAATTATGCATTGAGTTACCAA
TTATTAAACAATATGAATAACAATTGGTGCAAGCA
AATGAATTGGATTATAGACTCTGTTTGTTTGATTAT
TGATCTTATATAGTATATTTATTTCTTATTTCTTAAG
ACTAATTCATGGGAGTCTAAGAGTTCCATTTGCTAA
TGAATATCTGGCATGTGCTTTTCGAAATCAATGTCG
CAATTATTATTATGATTTAGCTATCTAGTAGGTGCC
TTTGGTGCACGTTATGCACACCATGGACATTATTTA
GTTGATAAGCTTCTGATTCTCTTGTTTCAAAGTCATT
ACCATGAATTAACTTTCTCTTATGCTTGGTTCGTATT
TTATTTTCTATTCATATACTAGTTTTAATAATTGACA
TTGCTGCTTAAATGCTGTTCTGGGTGGGCATCACTG
ACATTTAATATGACAAGTTGAAGTTCTTCATTGCCG
CATATATGGTTGAGTTCCTTCACAGTTCATGCAAAT
GGTCAAGACAATTGACTTTCTCTTAGAAGAAAGTTT
TCCTATTTTTTAACTTGAAAGGTTATAATCTATGTCC
TGTTTATATGTGCTATAGTCTCATAGTTGTTTTCATT
AAATAGGTGGCTGCATGGAAAGATAAAGATGGGG
ACTGGTATGAGACAGGCTTGCATATATTCTGTAAG
TTTCAGAACCCTTTTGGAGTCATTGTAATGCCACTT
CCATACTCGATGTGTTGTTGTTACTTTCCACCTTTTT
TGTCAAATCAATTTCATAGTTTCCTTTGACATGAAG
ATGCAGGAAATATTTTGTATATTAATTTTTTTTTAAA
ATATTTTGCTGGTTGTTGTGAATAGACATTGTTAAT
TTTATGCTGGACAGAGTTTTCTTTTTCCTTATTTGTT
TCAGATGCTTAAACTTTTGTGGTATATTGCTGTTCTT
ATTGAACCTGTCTTCTTTGGTTTACAAGTTGGAGCA
TATCCAAATGTGCAGAACCTGTTTGGAGAGCTAAA
CATCAATGATAGGCTGCAGTGGAAGGAGCATTCTA
TGATATTTGCAATGCCAAGCAAGCCAGGGGAGTTC
AGTCGATTTGACTTTCCTGATGTTCTTCCAGCACCTT
TAAACGGTATACAAGTTAAACACTTCCTGAAAATTG
ATTTCTCATGTGCAACTTTTTAGGAGCTAGCGAGAC
CTATAAAAATTGTTGGTAAGCATAGGAATTGTATAT
TTGGCTTAAATTTTATGAATGGAAACAATTGTATTT
TAGTTGAAAACCAGATTGAATCATTGAACTCTTATC
ATGTAACTCTTATATTTCATTGATTTTTTTGTATTTT
TCATATTTCTGCTCACATTGTTGATTTTTTGACTAAG
CACCCCTTTGTTTTCTCAGCAGTCACCTCCTGATTGT
TGTCCTCTACGTGAGACAGCTCTTGTTGTAGACATA
TCCATATATTTGTATATCAGCCAAACATATACCTTAA
ATGTATGATTTTTAATTGATTCTGTCTAGGCTTCAA
GGGATAGCTAAAAAGGACACATTTCTCTGTTTTCT
TGTGGGTTTTGTTATTGTGATCTAGGATATAACTAG
AGGAGTAGAGGTTGTCATATTATAATACAACCTTC
ACAAATTCATGATTTGTGGCAATGGAGAAGTTTAG
AATGGTGAGTTAAACCGTATTTTGGCCTTCAGAAG
TACCCAAGATTTACAATATGCGTATTAATTAATGAT
AAATGGAAATCAATTTCCCAATGTATATATCTTAAA
TAATTGCTCTATATGCTTCTATTTTTTTTGTGATCTTA
CAATTTCCTGTCATGCCTAAATTTTTTATGGTTATT
CAACTTATTTATCTATAGAACTATCATTTTTTTTTCA
ATTTTTGCTTATTTTATTGCATACTTTGGTATTACCT
GCAAAATATTGCTTAAAATTAATGTATATTTTCTAT
GGTTGTGCTTGACAGGGATATGGGCCATTTTAAAA
AACAATGAGATGCTGACATGGCCGGAGAAAGTGA
AATTTGCTATTGGACTTTTGCCAGCAATGCTTGGTG
GACAGGCATATGTTGAGGCTCAAGATGGTTTGAGT
GTTCAAGAGTGGATGAGAAAGCAGGTACTTTTGAT
AGATCCAAATCAATAAGAATAACACATGGCTTCTTA
TGGGCACAACTCTCCAGCCAAGGATCATGGAGTCG
CATTGATCATCGTGCAATTTAAACAGAAGAAACCA
GAATACTGAACTAAAATACTCAACATTGCTCGATTA
AAAATTGATTTATTTTCTGAAACTAGTAAAATCTAT
ATATGTATCAAGTATAACAAATAAACTCTGTTCTTG
ATATATATATTTTTTTTGTAATTTTCCGTGTTTGATT
GTCAGGGTGTTCCTGATCGAGTCACTAAAGAGGTG
TTCATTGCCATGTCAAAGGCACTAAACTTTATAAAC |

TABLE 1-continued

Weed species and PDS gene sequences

| SEQ ID NO | SPECIES | TYPE | LENGTH | SEQ |
|---|---|---|---|---|
| | | | | CCTGATGAGCTTTCAATGCAATGTATATTGATAGCA TTGAACAGATTTCTTCAGGTATGATACTTCTTCTTTC TCTTTCTATTCCTCGATGAGCTTTCCATTAATATTTTT TGAATGAATGTTTGTTGAACAACATTCATGTGTTTA GTTGGCTGAAAAGAAGTTTTGCTTTTTCTTTTCCTTT AAATAAATGAAATTCAAATTTTCTTTTACATTTTTCT CAGTTACTCTTGAAGATGTTATTGTTGAAAGATTGA GCATAAGCCTTATATAAACTCATTACAAATTTTTTA TACTTTTGTCATTTTTTCTCTATTTTCTAGAAGTTTCT CAATTTTTTCTTTGCCACTTCACATTAGATCTGTGGA AGTTTCTTATATAATGAAACTAACTGAATAAGGATC GATGGTAATATCAACAGGAAAAGCATGGTTCTAAG ATGGCTTTCTTGGATGGAAATCCCCAGAGAGGCT TTGCAAGCCAATTGTTGATCACATTCAGTCCTTGGG TGGTGAAGTACGGCTAAATTCACGAATAAAAAAAT TTGATTTAAATAATGATGGAACAATTAAGAGCTTTT TACTGAGTAATGGGGATGTGATAGAAGGGGATGC TTATGTTTTTGCCGGTCCAGGTAAACTTGAATTTTG GATAACAAATAACTTCTATTATTTTCGTGACCCATA TTTTCTGATACTAGTGTATTTTTCTTTTTCCTTTAGTT GATATATTGAAGCTTCTTTTGCCTGATAACTGGAAA GAGATTCCTTACTTCAAGAAATTGGATAAATTAGTT GGAGTCCCTGTCATTAATGTTCATATATGGTCAGTG ATGAATTCTTTTATCGAGTGACTGTTTATCTGAGAG TTCATTTACTAGCACATGGTTCACTAACAGAAATAT ATTTCTTTTCCAGGTTTGACCGGAAACTAAAGAATA CATACGATCATCTGCTTTTCAGCAGGTCCTACTCTT ATGCTTTTCTCTAGCTGTTCTTCGCCCATAGAGATTT CTACAATCATTTTCATAACTTCCTGAAAAGCTGTTA ATTTTCATCTTTTATGAAGGAATTCAGTTCATTACAA ATCATTTTACGTATAAATATTTTGAATCTTGTATGTA AAATGATTTCAAATGAATTGAATTCCTTCTAAAAGG AATGTTTTCCAATGGAGGGTTGAGTTGTTGCTATAA TAAGTTGACCTTCTGAATCTGATTTGTACCAATGAA GTTTGAAGAAATGCCTTTTCCCGTGCTATTGTACAT ACTGATTGTATATCTTCTTTTGACTTGCAGAAGTCC CCTTCTTAGTGTTTATGCTGACATGTCTCTTACATGC AAGGTAAAACTGGAACTAGTTATTTATTTTACCAAA ACGACTTGGCTGCTGCTATGCTAATTACTTTTGTTCT ATGAAATGAAAAGTAATAGTGGTCTGCTTTTTGTCT CCATACACATAATTTGGGCAAATAATATGATCTTTG TAGTCTTTGACATGTTAATTACAAACATTGAAGCAT CTCAAGTATCATCTTGTAAAAACTCCCCGGTTAGCG ACCTATTGTCTACGAACTTCTTGGCTCTGACCAAAC GCCTTTTGTCTATGAACTATTGATTTGGGGAATTTG GTTCTTGACCTATTGTACTCACTCTAGCACGTATAA CCCACAAATTAGATTTGCAACTTTGCTCAATTTATAT CAATACATGTAAAATAGTCAACATTATACTGCACAT CTATTATCAATTGCTTTAGGTATGACCCTAATGTCTC TGGTCAATAGGTCAGGGAC |
| 49 | Euphorbia heterophylla | Genomic | 3393 | TCTTGCTTATTTCAGTTCAGCACTTTTTGAAGTATGC TTGCTTCAATTTTGATTTATGGGTAGGTAGGGACTA CAATTATTTGATTTTTATTTTAGTTTTAGCGTTTAAA CATTTTTTCTCGGAAGCTGTTGTCCAAGTCAATAAC TTAGCATATTGTTTGGAATAAAATCTGCAGACTTT TGTGGTTATTTATGTACCTTTTTTTAATTTGGTTACG ATGGATTAACGCCTTTTACATCATGCTGCAGGGTTG GCTGGTTTATCAACGGCAAAATATTTAGCAGATGC AGGGCACAAGCCTTTATTACTTGAAGCAAGAGATG TTCTTGGAGGAAAGGTTATGCTTTACCTAGACTTCA AGAAAATTATGCATTGAGTTACCAATTATTACACAA TATGAATAACAATTGGTGCAAACAAATGAATTGGA TTATAGACTCTATTTGTATGATTATTTTCATTTAGC TAAGACTAATGCATGAGAGTATAAGAGTTTCATTT GTTAATGAATATCTGGCATGTGTCATTTGAAATCAA TGTCATCATCATTATTATGATTTGGCTATCTAGTAG GTGCCTTGGTGCACATTCTTCCGCCATTGAAATTA TTTAGTTGACCGGCTTCTAATTCTCTTGTTTCGAATT CATTACCAAATTTTATTCTTCTCTATCCATCCATAA TATAGTTTTCCTATATATTAGTTACATTCCTCCGTTT CTATTCTATTATTAGCAAGCCCTGTTGCTTGTATAT GTCTATTCATATACTAGTTTTATTTATTGGCATTGCT GCTAAAGTGCTGTTCTGTACGGGCATCACTGACATT TAATATGACTAGTTGAAGTTCTTCAATGCCGCATCA |

TABLE 1-continued

Weed species and PDS gene sequences

| SEQ ID NO | SPECIES | TYPE | LENGTH | SEQ |
|---|---|---|---|---|
| | | | | ATGGTTGAATTCCTTCACAGTTCAAGCAAATGGTCA |
| | | | | AACCAATTGACTTTCTCTAAGAAAAAAGTTTTTCTTT |
| | | | | TTTTTAACTTGAAAGGTTATAATCTCTTTCCTGTTAT |
| | | | | TATGTGCTCCAGGCTCATAGTTGTTTTCTTTAAATA |
| | | | | GGTGGCTGCATGGAAAGATAAAGATGGGGACTGG |
| | | | | TATGAGACAGGCTTGCATATATTCTGTAAGTTTCAG |
| | | | | AACCCTTTAGGAATGAGTCATTGTAATGCCACTTCC |
| | | | | ATTCTCGTTGTGTATTTGTATGTTAATTTTACTTGTC |
| | | | | ACCATTTTTGTGAAATCACTTTCATAATTTCCCACAG |
| | | | | TGAATTAATTTTTTTTTAAATATTCTTTTGGTTGTTG |
| | | | | TGAACAGGCATTGCTAATTTGATGCTGGATGTAGT |
| | | | | TTTTCCTTTTCCTTATTAGTTTCAGATGCTTAAACTTT |
| | | | | TGTGGTTTATTGCTTTACTTATTGAACCTGTCTTCTT |
| | | | | TGGTTTACAAGTTGGAGCATATCCAAATGTGCAGA |
| | | | | ACCTGTTTGGAGAACTAAACATCAATGATAGGCTG |
| | | | | CAGTGGAAGGAGCATTCTATGATATTTGCAATGCC |
| | | | | AAGCAAGCCAGGGGAGTTCAGTCGATTTGACTTTC |
| | | | | CTGATGTTCTTCCAGCACCTTTAAATGGTATACAAT |
| | | | | TTAAACACTTCCTGAAAATTGATTTTTCATGTGCAA |
| | | | | CTTTTAGGAGCTAGCGAGACCTATAAAAATTGTCT |
| | | | | GTAAGCATAGATATTGTATATTGGCTTAATTTTATG |
| | | | | AATGAAAACAATTGTCTTTTAGTTGAAAACCGGTTT |
| | | | | AAATTCTTATCATGTAATCTCTTATATTTCGTTGATT |
| | | | | TTTTTTGTAATTTTCATATTTCTGCTCACATTGTTGAT |
| | | | | GTTTTGCTAAGCACCCCTTTGTTTTCTCGGCACTCAC |
| | | | | CTCTTTCTGATTGTTGTCTTCTACTTGAGACAACTCT |
| | | | | TGTTGCAGACATATCCATATATTTGTATATCAGCCA |
| | | | | AACATATACGTTAATTGTATGATTTGTAATTGATTC |
| | | | | TGTTTAGGCTTCAAGGGATAGCTAATAAAGGGCAC |
| | | | | ATTTCTCTGTTCTCTTGTGGATTTTATTATTGTGATA |
| | | | | TAGGATATAACTAGAGGAGTAGAGGTTGTCATATA |
| | | | | ACAATACCACCTTCGCAAATACATGCTTTGTAGCAA |
| | | | | TGGAGAAGTTTAGAATGCTGAGTTAAACCGTATTT |
| | | | | TGGCCTTCAGAAGTACCCAAGATTTACAATATGCGT |
| | | | | ATTAACTAATGATAAATGGAAAGCAATTTCCCAATG |
| | | | | TATATATCTTAAATAATTGCTCTATATCTTCTATTTTT |
| | | | | TTTTTTTTGTAATCTTACAATTTTCTGTCATTTCTAAA |
| | | | | ATTTTTTATGGTCATTTAACTTATTTATCTATATAAC |
| | | | | TATTGTTTTTTCAAATTTTCTTAGTTTATTGCATACT |
| | | | | TCGGTATTGCCTACAAAATATTGTTTAAAAGTAATG |
| | | | | TATATTTTCTATGGTTGTGCTTGACAGGGATATGGG |
| | | | | CCATTTTAAAAAACAATGAGATGCTGACTTGGCCG |
| | | | | GAGAAAGTGAAATTTGCTATTGGACTTTTGCCAGC |
| | | | | AATGCTCGGTGGACAGGCATATGTTGAGGCTCAAG |
| | | | | ATGGTTTGAGTGTTCAAGAGTGGATGAGAAAGCA |
| | | | | GGTACTTTTGATAGATCAAATCAATAAGAATAACAC |
| | | | | ATGGCTTCTTATAGGCATAACTCTCCAGCCAAGGGT |
| | | | | CCTGGAGTCGCATTGATCATCGTGCAATTTAAACA |
| | | | | GAAGAAACCAATACTGAACTAAAATACTCAACATT |
| | | | | GCTCGATTAAAAATTGATTTATTTTCTGAAACTAGT |
| | | | | AAAATCTATAAATGTATCAAGTATAACAAATAAACT |
| | | | | CTGTTTTTGGTATATTTTTTTTGTAATTTTCCCTGTTC |
| | | | | GATTGTCAGGGTGTTCCTGATCGAGTCACTAAAGA |
| | | | | GGTATTCATTGCCATGTCAAAGGCACTAAACTTTAT |
| | | | | AAACCCTGATGAGCTTTCAATGCAATGTATATTGAT |
| | | | | AGCATTGAATAGATTTCTTCAGGTATGATTCTTTTTC |
| | | | | TTTCTCTTTCTATTCCTCGATGAGCTTTCCATTAATA |
| | | | | TTTTTTGAATGAAGGTTTGTTTAACAACTTTCATGT |
| | | | | GTTTAGCTGGCTGAAAAGAAGTTTTGCTTTTCCTTT |
| | | | | TCCTTTAAATAAACGAAATTGAAATTTTCTTTTACAT |
| | | | | TTTCTTGGTTACTCTTGAAGATGTTATTGTTGAATG |
| | | | | ATTGCACATAAGCCTTGAATATACTCATTACAAATT |
| | | | | TTTTATACTTTTGTCATTTTTTCTCTTTTTTCTAAAAG |
| | | | | TTTCTCAATATTATCTTTACCACTTCACATAAGATCT |
| | | | | GTGGAAGTTTCTTATATAATGAAACTAACTGAATAA |
| | | | | CGATCAATGGCAATATCAACAGGAAAAGCATGGTT |
| | | | | CTAAGATGGCTTTCTTAGATGGAAATCCCCCAGAG |
| | | | | AGGCTTTGCATGCCAATTGTTGAACACATTCAGTCC |
| | | | | TTAGGTGGTGAAGTACGACTAAATTCACGAATAAA |
| | | | | AAAATTTGAGTTAAATAATGATGGAACAATTAA |
| 50 | Euphorbia heterophylla | Genomic | 2627 | GTAAAACTGGAACTAGTTATTTATTTTACCAAAACG |
| | | | | ACTTGGCTGCTGCTATGCTAATTACTTTTGTTCTATG |
| | | | | AAATGAAAAGTAAAGTGGTCTGCTTTTTGTCTCCA |
| | | | | TACACATAATTTGGGCAAATAATATGATCTTTGTAG |

TABLE 1-continued

Weed species and PDS gene sequences

| SEQ ID NO | SPECIES | TYPE | LENGTH | SEQ |
|---|---|---|---|---|
| | | | | TCTTTGACATGTTAATTACAAACATTGAAGCATCTC
AAGTATCATCTTGTAAAAACTCCCCGGTTAGCGACC
TATTGTCTACGAACTTCTTGGCTCTGACCAAACGCC
TTTTGTCTATGAACTATTGATTTGGGGAATTTGGTT
CTTGACCTATTGTACTCACTCTAGCACGTATAACCC
ACAAATTAGATTTGCAACTTTGCTCAATTTATATCA
ATACATGTAAAATAGTCAACATTATACTGCACATCT
ATTATCAATTGCTTTAGGTATGACCCTAATGTCTCT
GGTCAATAGGTCAGGGACCCAAGGGGAACATCTC
GATCAATCAGCGTCCTTAAGTCTAGTTTTTCACTTG
AATTTGTGGTCCCTTGAGCTTGCTTAATTTCTAGGT
TTGAGATGATGTACAAAAACGTCCTCACGGTTGAA
TGGCATTTGGGCTCACTACAGTCCTCAAGTGAATTA
AACTTTTTACACTGTTTATTTAACAAAAAGTACTAA
ATCACAATTTCTTGTGGCACAGGAATATTATAATCC
AAATCAATCAATGCTGGAGTTGGTATTTGCACCTGC
AGAAGAATGGATCTCACGCACGGACACCGAGATCA
TAGATGCCACTATGAAAGAACTCGCAAAACTCTTTC
CCGATGAAATAGCTGCAGACCAAAGCAAAGCCAAA
ATTCTCAAGTATCATGTTGTAAAGACTCCCCGGTTA
GTCTCCTTTGAAAAATTGCATCGTTGATTAGTATCT
CACATGGTTTTGAAAACCAGACCGGACTGGCCAGT
TGGACCAGGTTTGACCAGAACCAGCCACTGGTTCG
GTCGGTGTTTAGTCTAAATCCGGTCAAAAACCAGTT
GTCTGATTATAACTTAAATCCGGTTCGACCACCAAC
TTAATTTAATTGAACCTTAAACCTATGACCGGTCTG
AAAGGTTCAAACTAATTGTAGTTGCGTAATGTTTGT
TTTACCCATATTTGTCAAAAGTGTGCCTCACGAAGG
GCGCGACCCTTGGCGCCTCGCCATACTACAGGCGA
GGTGGTGTTCCTATGGCGTACCCCTAAGGCCTAGG
GGTGAGCATTCCAATAATACCGAACCGAATTACCA
AATTTTCATAAAATTTTTTACTGAACCGAATTTCATG
TGATACCGAAATTTCCAAATGAAATTATTTCGGTTA
TCCGAAAAATTAAATTAATTAAAAAAATGCAATTGAC
TTTTCAATAAAAAGGTTTTCAAACTCAACCAGAAAA
TCTTAATTCATCGTATTGTGAACAAAACATAACATT
AGTTATCTAATAGTAATTCAACCATACATATAAAAC
AGATAAAAATATTATATGGATAAACCGAATTATGA
ATTTTCCGAGCCATACTGAACCGAAATGTGAATTAT
CCGAACCGAATTATGAAATATCCGAACCGAAATCC
GAAATATCCGAACCGAATTCGGTTCGGTAAGTTCG
GTAATTCGGATAATACCGAATTCTGCACACCGCTAC
CTAAGGCCCGCTTCAGGATTTTAACTTACTTTAATA
TGTGTTTTCCATTTATTTTTTAAGAGTTCTAATAATT
CAAATATTTATATCTAACATTTCTCTTCTCTTGGTTC
TTTTTGTGGCACTGTTATTGCATTTAAAGTCACCTAT
CAATCAAATTATTTTTTGCGCCTAGTGTACCTGGAG
TGCGCCGTGCCTGGCTCCTTTGCGCCTCTAACAACT
ATGGTTTTACCTTCAGGTCGGTTTACAAGACTATCC
CAAACTGTGAACCATGCCGCCCTTTGCAAAGATCAC
CCGTGGAGGGGTTCTATTTAGCCGGTGACTACACA
AAGCAGAAGTATTTGGCTTCAATGGAGGGTGCTGT
CCTATCTGGCAAGTTTTGCGCTCAAGCCATTGTACA
GGTACTTGTTTTTCACTTTTTCTTGAAACGATTTCCG
ATTTGTATTAGGATATTATAGTTTCTTTTTCTTAAAT
GTCAGCCATCTAGCTTTTATGCATAGTCGATGATAT
TTTATATGACGCAGGATTATGAGTTGCTTGCTGCTC
GGGAGCAGACAAAATTGGCTGAGGCAACCGTTAG
TTAACAATGTAAATACTGTTTAAGGTATAGAGAAA
ATCATCTGATTAGTGATCATAATACACAATTAAAGC
TCAAAGAAACCAATTCTTGTACTAATACCGTTTTGG
TTGTATAATCATATATTTTTTGCCAGCATTTGCTGTT
TTGTGCACATATTTGGGAACAAAATTCAGTGAAAC
CGTGCCAATATGTATAGGGTCGTATACACCTATTTC
TCATTTAACTTCCGAAAATTTCTAACGTGTTTTGCAA
GAACTATAATTTGGTTTTAAATTTCTTTAAAGTTCTA
TTAGTGGTTGAAACTGAATATTTGACTCTAGATTAT
TGCACGGTATGACAAGAGTGTTATATATTATTTTTG
AACTTTTGAGAATCCTAATCCTTTATCTATAGCTTTG
CTAATTT |
| 51 | Euphorbia heterophylla | Genomic | 858 | GGTAAAACTGGAACTAGTTATTTTATTTTACCAAAA
TGACTTGGCTGCTGCTATGCTAATTACTTTTGGTCT
ATGAAACGAAAAGTAATAGTGGTCTGCTTTTTGTCT
CTATACACGTAATTTGGGCAAATAATATGATTTCGG |

TABLE 1-continued

Weed species and PDS gene sequences

| SEQ ID NO | SPECIES | TYPE | LENGTH | SEQ |
|---|---|---|---|---|
| | | | | TCAATGAGGGTCCTAAAGTGTTTTATTTCACTTGAT<br>TTTGTGGTCCCTTGAGCATGCTTAATTTCTAGGTTT<br>GAGATGATGTACAAAAATGTCCTCACGGTTGAATG<br>GTATTTTTGGCTCACTACAGTCCTCAAGCGAATTAA<br>ATTTTTACTGTTTATTTAACAAAAAGTACTAAATCAC<br>AATTTCTTGGGGCACAGGAATATTATAATCCAAACC<br>AATCAATGCTGGAGTTGGTATTTGCACCTGCAGAA<br>GAATGGATCTCATGCACAGACACCGAGATCATAGA<br>TGCCACAATGAAAGAACTCGCTAAACTCTTTCCCGA<br>TGAAATAGCTGCCGACCAGAGCAAAGCCAAAATTC<br>TCAAGTATCATGTCGTAAAAACTCCCCGGTTAGTCT<br>CCTTTAAAAAATTGCATCCTTGATTAGTATCTCACAT<br>GTTTTGAAAACCGGACCCGACCGGCCCGGTCAGAC<br>CAGGTTCGACTGGAACCAGCCACTGGCCCGGTCGG<br>TTTTCAGTTGATTCTTAATCCAGTAAAAAACCAGCT<br>GTTGTCCGGTTATACCTTAAGTCCAGTTTGACCACC<br>GATTTGGTTTAATTGAACCTTAAACCTATGACCGGG<br>TCTAAAGGTTCTGTTCGAGATGTGTGGTGGCATCC<br>GACATCGGAAATAAACAAGTGAAAAGAGTAGAAT<br>ATAAGTGGAGTAGATTGGACCTTAACACAAGCCAA<br>TT |
| 52 | *Euphorbia heterophylla* | Genomic | 768 | TCAATTTTGTAAATATTTTGGAAATATTGTATAATTA<br>TGATAAATTCCCTTTTATCTTCAGGTCGGTTTACAA<br>GACTGTCCCGAACTGTGAACCATGCCGCCCTTTGCA<br>AAGATCACCCGTGGAGGGGTTCTATTTAGCCGGTG<br>ACTACACAAAGCAGAAGTATTTGGCTTCCATGGAG<br>GGTGCTGTTCTATCTGGCAAGTTTTGTGTTCAAGCC<br>ATTGTACAGGTACTTGTTTTTCTTGAAACGACTTCC<br>GATTTGTATTAGGATATTATAATTTCTTTTTCTTAAA<br>TGTCAGCCATCTAGCTTTTATGCATAGTCAATGATA<br>TTTTATATGACGCAGGATTATGAGTTACTTGCGGCT<br>CGGGAGCAGACAAAATTGGCTGAGGCAACCGTTA<br>GTTAACAATGTAAATACTGTTTAAGGTATAGAGAA<br>AATCATCTGATTAGTGATCATAATACACAACTAAAG<br>CTCAAAGAAACCAATTCTTGTACTAATACCGTTTTT<br>GGTTGTATAATCATATATTTATTACCAGCATTTGCT<br>ATTTTGTGCACATATATGGGAACGAAATTCAGTGA<br>AACCGTGCCAATATGTATAGGGTCGAATACACCTA<br>TTTTCTCATTGAACTTCCCAAAATTTCTAAAGTGTTCT<br>GCAAGAACTATAATTTGGTTTTAAATTTCTTTAAAG<br>TCCTATTAGTGGTTGAAACTGAATATTTGACTCTAG<br>ATTATTGCACGGTATGACAAGAGTGTTATATAGTTT<br>ATCTATAGCTTTGCTA |
| 53 | *Euphorbia heterophylla* | Genomic | 634 | TTGCCGGTCCAGGTAAACTTGAAATTTTGGATAAC<br>AAATAATTCTATTATTTTTGTGATCCAGTGTTTCTAA<br>TACTAGTATATTTTCTTTTATCATTAGTTGATATATT<br>GAAGCTTCTTTTGCCTGATAACTGGAAAGAGATTCC<br>TTACTTCAAGAAATTGGATAAATTAGTTGGAGTTCC<br>TGTCATTAATGTTCATATTTGGTCAGTGATGAATTC<br>TTTTATCTAGTGACTGTTTATGTGAGAGTTCAAATA<br>TCAGCACATGATTCACTAAAATAAATCTATTTCTTTT<br>TCAGGTTTGATCGGAAACTAAAGAATACATACGAT<br>CATCTGCTTTTCAGCAGGTCCTGCTCTTACGCTTTTC<br>TCTAGCTGTTCTTCACCCATAGAGATTTCTACAATC<br>ATTTTTGTAACTTTTTTAAAAGCTGTTATATTCTGAA<br>GGGTTCTGTTAGGGGTACGAAAACCTTCTTTCATG<br>AAGGAAATCAATTCATTACAAATCATTTTATGTATA<br>AATTGATTTGAATCTTGTATGTAAAATGATTTCAAA<br>TGAATTTAGGTCCTTGAGAAATAATGTTTCCAAATG<br>GAGGTTAAGTTGTTGCTATAATAAGTTGACGACCT<br>GAATCTGATTTGTACCACTGA |
| 54 | *Euphorbia heterophylla* | Genomic | 399 | TTGTGTTAGATGGGCTCAACCCTACTTGTATGCTCA<br>CTCGTCCTATCGAGCCCAACACTCTCCAGGCCCACG<br>GATTCTCTACAGGTTCAAACAATAGTAACGTCACTT<br>ATCAAGCAAATTAATTTTTGCGCCTAGTGTACCTCA<br>AGTGCACGCTGGGCCTGGCCCCTTTGCATCTCCAAC<br>AACTATGGTTATACCTTGCGGTTTTCATAAAAAGCC<br>TCAAAATATAATTTCAGCTCATACCAGAAAATATTT<br>ACAAGTTTACAAAAATAGGGGTAAAATATTGACAA<br>AAATACAGTCCGCTATTTTTCATATAGTTTTCATCTG<br>GTGTGCTAGTTTTCATATAGTTTCCATATAGTTTTCA<br>TTAGGTTTTCATCCAGTTTTTAGACCGTATTCATGTAA |

TABLE 1-continued

Weed species and PDS gene sequences

| SEQ ID NO | SPECIES | TYPE | LENGTH | SEQ |
|---|---|---|---|---|
| 55 | Euphorbia heterophylla | Genomic | 283 | TTTTTTTGTTGTGGTAAAATTTCCCAGCCCTCTTTCT ATAGGGAAGTTGAACGGGATTATTTTTTTTTTTACC GAAGAATCAACATGAAATATCTCCGATTTTTTCTTT CAAACGATATTTATTTGTTCAATCACTTGTTTTAGCT CAACATTTTCTCCCACTTTTGTAATATTAAGCTTATT TTACATTTATCAATCAAAATTTTTATTCTTTTGACAT GACATGGATTATATATTAAACACATGTCTTTTTACA TATTTCTCTCAAAACGTGATCTATACT |
| 56 | Euphorbia heterophylla | Genomic | 40 | AAATTATTTATGGTTGGACAGTAAATTTGTAAATAG TTTA |
| 57 | Commelina diffusa | cDNA | 378 | GGGTGTACCAGACAGGGTCAATGACGAAGTCTTTA TTGCCATGTCTAAGGCACTCAATTTCATAAACCCAG ACGAGCTTTCCATGCAGTGCATTTTAATTGCTTTAA ACCGTTTTCTTCAGGAAAAGAATGGCTCCAAGATG GCCTTCTTAGATGGTAACCCTCCTGAAAGATTATGC ATGCCAATTGTTGATCATGTCCGCTCCTTAGGTGGT GAGGTGCAGCTTAATTCACGTATTCAGAAAATTGA ACTAAACCCTGATGGTACTGTGAAGCACTTCCTGCT GAGCAATGGAAATATCATTACAGGAGACGTTTATG TATTTGCAGCTCCTGTTGATATATTGAAGCTTCTTTT GCCTCAAGAATGGAGGGAAAT |
| 58 | Commelina diffusa | Genomic | 383 | CGCCTGTCATCTTAGCATCCTCATAAAGTCAAGAAA TTGTGAGGACAAATATATTTACTAACTGATGGAAA CTTGATGTTTTTATCGTGGTATCCAGTATCCACTTGT GAGCTGTTCTGTAGATTGATATATAGGAAGATATA TGACAAACAAGATTTCTATGATTTTGCTACCACTTA TAAGCAAAGAACAAAAGAAGTACAATAGATATGTA TATATATATCTCTCGCATGCTTTTCTTTAAAACTATA ATGGGTGTACAATGATTATGATTTTTTTTGTGTGTG TATGCCTACAGGGTGTACCAGACAGGGTCAATGAC GAAGTCTTTATTGCCATGTCTAAGGCACTCAATTTC ATAAACCCAGACGAGCTTTCCATGC |
| 59 | Commelina diffusa | Genomic | 293 | TAATCGCTCCATGCTAGAGTTAGTATTTGCTCCTGC TGAGCAGTGGATTTCACGGTCTGATAGTGAAATAA TTGAGGCAACTATGCAAGAACTAGCCAAGTTATTT CCCGATGAGATTGCTGCGGATCAGAGCAAAGCCAA AATTCTGAAATATCATGTTGTGAAGACACCAAGGT AGATCACCTTTGTCTCTTTNCCAGCACTTTTCATTTT GGTCCTTTGGATATTTAAATCTTGCAGAGAAAGGG GAAGGGTAGATAATAAATAATTAGCCTACTTACTG CCATAGCACA |
| 60 | Commelina diffusa | Genomic | 284 | CCTATTGGGCCGTTCACTGGTCTATTGTTGAAACAG TTGATATATTGAAGCTTCTTTTGCCTCAAGAATGGA GGGAAATTCCCTACTTTAAGAAGCTGGAAAAGCTA GTGGGAGTTCCAGTGATTAATGTCCATATATGGTG AGTCATTTTTTCTCTAGCAATTTCTGCTACTTCTTAG TGACAGTCCCTCATATAAATGAATAGTATATGATTT ATTTATATATTTCTTATGATGTTCTTATTTTTAAGCTT AATTGTTTGTATACATGGGTTGAGATACTTC |
| 61 | Digitaria sanguinalis | cDNA | 458 | AAAGAAGCCAAAAACAATCTCAACCCAACAACATC TTCTTCTTCTTCTAATAATAAGTACCTGCAAGGTCAT GTCTCTACTTGGAAATTCTATAGTAACCACCCATGT ACTGTCCTTTAGTCACGCTGATATTATGGGTGCTCA TCGGTTGCAATTCCCGGCTGTCCGATCAAGAACCA CCACTACCAAGAATGTCTGCCCTTTCAAGGTGCTCT GCCTGGATTATCCAAGACCAGACCTTGACAACACTT CTAACTTCCTGGAAGCTGCCTACTTGTCTTCTACCTT CCGCACTTCCCCTCCTCCAGCTAAACCCTTAAACGT TGTAATTGCTGGTGCAGGTTTGGCTGGTCTATCCAC TGCTAAGTATTTGGCTGATGCCGGTCACAAGCCCCT TTTGCTTGAAGCAAGAGACGTTCTTGGTGGTAAGG TAGCCGCTTGGAAAGATGATGATGGAG |
| 62 | Digitaria sanguinalis | Genomic | 7350 | TTTCTTTGATTTTCTATGATTTTCTAAAGTTTTGGAG AAAAAACTTTGGCCATCTATGATTTTCCATTTTCTAT GATTTTTTTATTTTCTATGATTTTCTAAAGTTTCTAT GATTTTCTAAAGTTTTGGACAAAAATATTTATGGAG GACATTTGATAAGACATCTATCTATAAAGCCCACTT |

TABLE 1-continued

Weed species and PDS gene sequences

| SEQ ID NO | SPECIES | TYPE | LENGTH | SEQ |
|---|---|---|---|---|
| | | | | TGACCCATTTAACTAGGATAAGTAGAAATAAGACC |
| | | | | AATTAAAGAATATTTACTTATACATGTTCAACATTTT |
| | | | | TTGTTAAACAAGTTCAACATTTGATAATGAAATGTC |
| | | | | GACATTGATTAACCTAAATGTTGCAATTGGAGAAC |
| | | | | AGCAATATTGAAATCAAAGGGCCGGAATGTTGAAT |
| | | | | GCTCAAATCATAAATGTTGAATGCTAACATCACCAA |
| | | | | TGATGAACTTTATCTCGTCTTCTCCGGGCACGGCGG |
| | | | | AGCAGCAGCGGCGTCTAGGCCAGGCCGCGCGACA |
| | | | | GAGCAGTGGCGGCCTAGGCCAGGGCGCATGCATG |
| | | | | GATAGCGGGAGCGGCGGCGGCGCCGGTGTGGAG |
| | | | | CAGGCCATGGTGCGATCAGACTTGGCCCCATGAGA |
| | | | | GGGCTCCGACACTGTGCGGGTTTGGTCGGTGGTG |
| | | | | GGTGTGGCAGGATGACCCGAGGCTTCCTACATAAT |
| | | | | TTCTATCCATCTGTGATAAGATTTTAATTTCTACATA |
| | | | | TTTAATGTTTGAGATCCGTATAAATAATTACAACTC |
| | | | | TTAAATCTACACCTCTCAAACCCTATCTCCCTTTCTA |
| | | | | ATCCCCTGCTCCCTCTCCTACACTACACCTGCCGC |
| | | | | CCACCGTGTTACCAAATACGATACACTTAAATAGGT |
| | | | | GTATTTACAATTTATTTGAAAATATAAATAGATAGA |
| | | | | GTATATAAATATCTATAATTATGCAAAATTTAAAGT |
| | | | | TTAACAAAAATTTGTGCAAAGAGATAAAAAAAAGG |
| | | | | AAAACTCAACACTAAATAGTTGCAGATTGCGGGTT |
| | | | | TCCAATGAAAAGTAAAGCACACAACTATTTATGTGT |
| | | | | TGGTTTCTCTTTTTCATATCTCCTTGCACAATTTTTTG |
| | | | | TTCAACCAGAAACTTTGCATGACGAGAGATGTTTAT |
| | | | | AAGCTTTATCCATCTATACTTTTAGATGAATTTTAGA |
| | | | | CGCACCGATTTAGTGTGCTACCGTGTTTGGTAACAC |
| | | | | AGTAACATTTAAAATCCTCTGTCCCAAAATTTAAGC |
| | | | | ATTAATTAAATATATATGCTAAAGTTCCTCATGCCTT |
| | | | | GTGGCCTCATGTGGGACCTACGTACTGTTTATGTG |
| | | | | GGACCCACGTGTTATTTAGGTGAGCCCTATGTAGG |
| | | | | ACCCACGTGCTATTTATGTGGGACCCACGTGCCATT |
| | | | | TAGGTGGGACCCACACACTATTTAGAGTGGGACAC |
| | | | | ACTCTCTTTGGTGGGGCCTGCTTAGTGGGACCCAC |
| | | | | AACAATATTAAGTGTCTATGTTAAAAATTATCGAGG |
| | | | | ATTGTTTTTCCATTCTTTGCGGTATAAATATATTTAT |
| | | | | TTTTCTATGTATAAAAATAATATCTAACTTTGTATAC |
| | | | | TACATTCATTTGTGATAGTTCTAATATTTTTTCTACT |
| | | | | TTGCTTTAAGATCATAAATTTGGAAAATAAGATCGA |
| | | | | ATTATACATTCATTACTAAATTTATCTTTCCTTCTATA |
| | | | | AAAATTTAAAAATTAGTGTAACATAACACGTCACTT |
| | | | | CATTAGCTATTTCTATTACCACTTAGAAAAAAGTTA |
| | | | | TATAGCTCTTAAATGATCATTATAATTAAAAAATAT |
| | | | | GTAAACTTAATATTGCAATTGAGTATAGTAAGATG |
| | | | | ATAAATTTGTATTGAGTTTAACATTTTTTATATAGAT |
| | | | | GAGCATGGCGCGTCAACCTGACTAGTATGTTATTA |
| | | | | GATTTCCCAATTATAACATTTTTAATAAATTTAGACA |
| | | | | CTTATTCTACTTATCTAGGTTCACCGAAGATTCTATA |
| | | | | AATTTAGTGAAAGGCTAGAAATATTTATATATTTTG |
| | | | | TAAGGGAGGGAGTAGACGGAGATGGCAGGTTACA |
| | | | | CAATGAACGAGCTGCCACGTTGACTCAAATAGTTG |
| | | | | CCACGTGTTATCTAGTTTCTTTAAAAAGAAAGCACC |
| | | | | AAGAGAAAATAAGAGAGATGACGTGGCGGTATAT |
| | | | | ACCGCGGAGACGTAGAGCGCACCAGGCGCCAAAA |
| | | | | GGCATCCTCCTCCTCCACATCCTCCTCACCCCGCGCT |
| | | | | CGTCGTGCTCTTGTCCCTTTCCACCGCCCCAACCAA |
| | | | | GTCAAGTGCGGAGGAGGCCGCCCGCCTCCCCTTAT |
| | | | | CATCGCGCGACACGGCTTCCTCCCCACCTGGGCTCC |
| | | | | TCCGCCTCCACGCCGCTCCCCGCTGCCCCGCCTCCC |
| | | | | CTAGTCCCTCCCTCCTCCTCATCCGGTAAGTCCTCGT |
| | | | | TGCCTGCTCACGCTGCGTTTCCATTTAATCACGCGG |
| | | | | GAGTCAGGTCAGGCGGGATTCGGTTCCCATGGGG |
| | | | | ATGGGGCGGCTCTCGTGGTACCTGCGACCGGAA |
| | | | | ATTATTAACGGGCTATATAGAAATGGGGGATTTCT |
| | | | | TAGGGTTTGTGCTTTGAAGGCATTGGAAAATTGTG |
| | | | | ACTGGTTTGGGGAATTGGCAGTTACAACTTACATG |
| | | | | GAGTAGTCTGCAGTTGTTGGGCACAGAGTTTTAGC |
| | | | | GGTGTTCTGGTAGTGTTTATAGAGTATGGCACACA |
| | | | | TTGTATAGTATAGGGAGACTTTTGGTTCAAATTTAA |
| | | | | TATTAGACGGTCATGCTACAAAATGGAGGTCCAA |
| | | | | GTTGTGTATTCTGTTTCCTTTGCATCATTGTTAACTC |
| | | | | ACTGCTTGTTCTCAGCATAGAATAACTAAATCAATG |
| | | | | TGTACCAACCTTGATCAGTTTACTTACATACTTGGA |
| | | | | AGATGCGCGTAAGAAATGATCTCATGAACTGCCAG |
| | | | | TCTAATAGCTCCTCTTGGTTATGCAGTAGTCTGCCT |

TABLE 1-continued

Weed species and PDS gene sequences

| SEQ ID NO | SPECIES | TYPE | LENGTH | SEQ |
|---|---|---|---|---|
| | | | | CTGCGTATTGGTTAATCAGAGCTGACAACAATCAC
CAAAAGTTGCTTCGACATGGATACTGGCTGCCTGT
CATCTATGAACATTTCTGGAGTGAACCAAACGAGA
TCTTTTGCGGGACAGCTTCCTACTCAGAGATGCTTT
TCAAGTAGTCACAACGCGAGCTTTGCTGTGAAATC
TCTAGTTGTAAGGAATAAAGGAAGAAGGTCACACC
GTAGACATTCTGCTTTGCAGGTTCAGTTTTTTGTTC
ATTTTCTTCTCCAATTTTTCAGGTCATTTCTTAGTGAA
AATATGATTGATTAGCTTTTCTGCAGATTGTCTGCA
AGGATTTCCCAAGACCTCCACTAGAAAACACAATA
AACTATTTGGAAGCTGGACAACTCTCTTCATTTTTT
AGAAGCAGCCAACGCCCCAGTAAACCATTACAGGT
CGTGATTGCTGGCGCAGGTCCGACGTGATTTGTGA
TTAATGTTTTCACAAATCTTTTTGTCAGTTACTTCCA
GGGTAATAACAGTTGAGTTTTAGCTTTATTAATTTG
TGGTGTAACTTTTGCAGGATTGGCTGGTCTATCAAC
GGCGAAATATCTGGCAGACGCTGGTCATAAACCCA
TATTGCTCGAGGCAAGAGATGTTTGGGTGGAAAG
GTCTGAAAGATACTTACATGATTGTTTACAATGCTC
TTAATTGCTCGCATCCGGTGTTTTCATCGTTTGTTCC
TTTAATGATTTTTTTTTGTTTTTTTGTTTATGCACTG
AACAGATAGCTGCTTGGAAGGATGAAGATGGAGA
CTGGTATGAGACTGGGCTTCATATCTTTTGTAAGTT
ACAGTTTCTGGTCCTTAAGGTTGTCTTCATGATATTT
TATTTTCTAGATTATTTCTATTAGAAACATACATTTA
ATGTAGACATGTTAACAAGCTGTTAAGGCGCACCA
GCACACAAACTTCTAAAGCACAGTTGTCTATCGTGC
TTGTTTATTTCCTTTAAGGAATATCTGTTTTAGTTTG
CAAAATTATTATTGAGAAAGGAGTTTTTTTTTAAAT
TACTAATAGCGTGAAAATAGCATGGAAAGTTTGCA
GGCTACTAAAAAAGCGTACATCAGTGCATGTTTTA
ATGTTACGTAAACGTGTTGTATACTCCTTATTATCC
ATAATGGCATAGTTGAATATCTGTTATTCTGTTCAC
AAGAACATTCGATTGCTACCATTCCCTTCATAGCTT
ATATAACACTGCGTGTATGTAACCATGCATTTTTGT
TTTAAGTTGGAGCTTATCCCAACATACAGAATTTGT
TTGGCGAGCTTGGTATTGAGGACCGTTTACAATGG
AAAGAACACTCCATGATATTTGCCATGCCGAACAA
GCCAGGAGAATTCAGCCGGTTTGATTTCCCAGAAA
CTTTGCCAGCACCTGTAAATGGTACGACTATGCGAT
TTTGGAGTTGTTGCAACTGATTTCCTAGATAATCCA
GAAATACATTCTAATCTTAGTCTACTCATTTTGCTTA
TGGACAGCATTAACGCTTCCAATTGATGCTGTACTA
TGATTCACCACTGTACTTTTAACAGGAATTTGGGCC
ATACTGAGAAATAATGAAATGCTTACCTGGCCGGA
AAAGGTGAAGTTTGCTATTGGGCTTCTTCCAGCCAT
GGTCGGCGGTCAACCTTATGTTGAAGCTCAAGATG
GCTTAACAGTTTCAGAGTGGATGAAAAAGCAGGTA
CGAATTCAATTTGTCGATTAGACTAGTCTCTGTGTA
ACAGAAATACTGCCATCTCATCAGTACTAGAGAGC
TTTTAGTTTACCAATAGATTGTTTCCTTTTATTTTCTT
ATCTTCCTGAAGAAGTACAGGTAGCTCCATAAAAT
GCTTTATATGCTCAAATTCTTAACTTATATTTGGTGT
AAATCTTTTTCTGTGAAAATTAAGACAGAGCAATGC
TTATAGATGCATTAACTTGGCCAGTTAAAGGCCAG
CAATGTTCATCATGTTAAGTTCAGCAATGTACCAAA
AAAATGAAAAAAAAAAAACACACAAGAGACATAAT
GGTTTCTTGCTAACTGATACACATGCCGTTTTCTTCA
AAAATTGGTTTCACCTTTGTCGTTTGGAATACAGAT
GGTAATATATCTTTCTATTTTTCTGTGGAGATATGT
GGTGCCTGATACAATTATTTGATCAGCACAGGGTG
TTCCTGACCGAGTGAATGATGAGGTTTTTATTGCAA
TGTCCAAGGCACTCAATTTCATAAATCCTGATGAGC
TATCCATGCAGTGCATTTTGATTGCTTTGAACCGAT
TTCTTCAGGTACATCTGTTGTTGCTCTATGTTATTGT
GTAATATATTACTTGCCTGTTCTGTTTGGAGAAATA
GCTTACATATGTTGATTCTTGCTTTCTTGTCTGTACT
CTGTATTATTTTTGAACTGAGAGAGATGCCAATATG
TATTTGCATGTGGGTATTTTGTGTAAACGTGCAGG
AGAAGCATGGCTCAAAAATGGCATTCTTGGATGGT
AATCCACCTGAAAGGCTGTGCATGCCTATTGTTGAT
CACATTCGGTCTAGGGGTGGTGAAGTTCGCCTGAA
TTCTCGTATTAAAAAGATAGAGCTGAATCCTGATG
GAACTGTAAAACATTTTGCACTTACCGACGGAACTC
AAATAACTGGAGATGCTTATGTTTGTGCTACACCA |

TABLE 1-continued

Weed species and PDS gene sequences

| SEQ ID NO | SPECIES | TYPE | LENGTH | SEQ |
|---|---|---|---|---|
| | | | | GGTGTGATTTATTACCAGTAAACCTTGTTTCCTGTG<br>CAGCTATACTGCTATACAACTGAAGTACTGAACTGA<br>CAAGTCTTTGTATTTAGTTGATATCTTCAAGCTTCTT<br>GTACCTCAAGAGTGGAGTGAAATATCTTATTTCAA<br>GAAGCTGGAGAAGTTGGTGGGAGTTCCTGTTATCA<br>ATGTTCATATATGGTTAGTTAATTGAAATATTTGGT<br>TCTGAATTGGAAATGCTCCATTTCCTTATATGGTTA<br>TGCTTCTTCCTTGAGGCATTTCTGAAGCTTTGCTGA<br>GAACTGTTGTTTTGAATGCCTCAGGTTTGACAGAA<br>AACTAAAAAACACATATGACCACCTTCTTTTCAGCA<br>GGTACATCTTCTGGCCATATTCTTAGTTCATGCATTT<br>TTTGTGCAATATTTCTTGATTCATGCACTGTTCAGGT<br>TGTGCACATTTACTGTTGATGGTATTAAATACCATA<br>TGGCCCTTGTTGATCTTGTCAGTAACCTGCATTTTTT<br>TTCAGGAGTTCACTGTTAAGTGTTTATGCAGACATG<br>TCAGTAACCTGCAAGGTACCGACTATCATCTTCAGG<br>GCAATATCAGTTTTGTTCAAACACTAGCATACTAAT<br>ACATTGGCCATGATTTCTTCATTAATTCTAGAGGCT<br>CAGTGACCTTTACATGCGTCATCTACATAAACGGTC<br>CTAGGGCTCAGATGATTAAGAAAGAATTCATTATA<br>AGTGGAAATATAAATATCTTGCACATTAAAAATTTT<br>GGACATCTGTGCTAGATGTATTGAAGTGTGTGACT<br>TTGTCATTGCTTACATGTCAGTGGTCACTGTGTTGT<br>ATTGATGAATCATGATATGTTAAATAGCGAAGGAC<br>ATGATTGCAGATTGCACACTCACCTTTTTTCTTTCCT<br>TTTGTTGTCTAATTCTTTACAGGAATACTATGATCCA<br>AACCGTTCAATGTTGGAGTTGGTCTTTGCTCCTGCA<br>GAGGAATGGATTGGACGAAGTGAAACTGAAATCA<br>TTGATGCAACTATGGAAGAGCTAGCCAAGTTATTT<br>CCTGATGAAATTGCTGCCGATCAGAGTAAAGCAAA<br>GATCCTTAAGTATCATGTTGTCAAGACACCAAGGT<br>GAGGATATTTGTCGGACACTTCTGATAGATAAGCA<br>AGTAGCTCTAGCTCTGACAGTTTTTTGTGTTGTTTCC<br>TTTTGTTCATATTCTGGCTTGCTTTGACAGATCGGTT<br>TACAAAACTGTTCCAAACTGTGAACCTTGTCGACCT<br>CTTCAAAGGTCACCGATCGAAGGGTTCTATTTGGCT<br>GGTGATTACACAAAGCAGAAATACTTGGCTTCCAT<br>GGAAGGTGCAGTATTATCTGGGAAGCTTTGCGCCC<br>AATCTATAGTGCAGGTAAATACACGCCATGTTCCTT<br>GCTGTACATAAAAGCATCGGATTGCTTATAAGTTTG<br>ATCGTTTCGATGTGATACATTTTTGCAGCTAATTATT<br>TAACATCTGCTGCTTTCAGGATTATGGCAGGCTCTC<br>CCTCAGGAGCCAGAAAAGCCTGCAATCCGAAGAA<br>GTTCCTGTCGCATCTTAGGCATAGTTCAGGCTCCCA<br>TTTGGTGTGTCATCTTATCACCTATTTCGTGGGAAC<br>CCACCAACTGCTCATGTTGAGGGACCTGACCTCTTG<br>TGCCCCTCTGACAATTCCCTAGAGCTGAAATGTGAC<br>AGTAGTTGATATCATATTGGGAAACAGGTGATATA<br>TATGTAAAACGACCTGCATAGCAATTCTTAGACCTT<br>TGCAAAAGGAAAAGCGAAAAAAGATATCTCAGAT<br>AGATATTATCTTGT |
| 63 | Digitaria sanguinalis | Genomic | 2640 | GTCTGAAAGATACTTGCGTGATTGTTTGCAATACTC<br>TGGTCCTTTTCATCGTTTGCTCCTTTTATAATTAGTT<br>TTTTCGTTTATGCACTGAACAGATAGCTGCTTGGAA<br>GGATGAAGATGGAGATTGGTATGAGACCGGGCTT<br>CATATCTTTTGTAAGTTACAGTTTCTGGTCCTTGAG<br>GTTCTCTTAATGATATTTGATTTTCTAGATTATCTCT<br>ATTAGAAACATGCATTTAACGAAGACATGTTAACA<br>AACTGTTGAGGCATACCAGCACACAAACTTCTAAA<br>CCACAGTTGTGTCTATCGTGCTTGTTTATTTTTTTTT<br>ATGGAATATCTGTTTTATTTTGCAAATCATGATTG<br>AGAGAGGAGTTTTGTTAAATTACTTAGTGTCAAAA<br>TAGCCTGAAAAGTTTGCAGGCTACTAAAGCATACA<br>TCATTTCATGTTTCAATCATGTTGTATACTCCATAGT<br>ATCCATAATGGCATAGCTGAATATATGTTATTCTGT<br>TCACAAGAGCATTCGATTGCTACCATCCCTTTATGT<br>AACAATGCATTTTTTGTTTAAGTTGGAGCTTATCC<br>CAACATACAGAATTTGTTGGCGAGCTTGGTATTG<br>AGGACCGTTTGCAATGGAAGAACATTCTATGATA<br>TTTGCCATGCCGAACAAGCCAGGAGAATTCAGCCG<br>GTTTGATTCCCAGAAACTTGCCCGCACCTGTAAA<br>TGGTATGATTATACACGATGTTGAAGTCGTTGCAA<br>CAGATTTCATAGAGAATCCAGAAATGCATTGCTTCA<br>GGCTGGGGCTGTGTCCCTAAAACTCTAAAAGAAAA |

TABLE 1-continued

Weed species and PDS gene sequences

| SEQ ID NO | SPECIES | TYPE | LENGTH | SEQ |
|---|---|---|---|---|
| | | | | TGCAGAAATGCATTCTAATCTTAGTCCACTCATTTTT<br>TTCTAATATATGACAGCATTAGAGGGTTTATTAGTG<br>GCAGTAGTAACACTACATGATTACCATTCAGCTTAC<br>ACTTCCAATTCATGTTGTACTTATGATTTACCATTGT<br>ACTTTTAACAGGAATTTGGGCCATACTGAGAAATA<br>ATGAAATGCTTACCTGGCCAGAGAAGGTGAAGTTT<br>GCTATTGGGCTTCTTCCAGCAATGGTTGGTGGTCA<br>ACCTTATGTTGAAGCTCAAGATGGCTTTACGGTTTC<br>AGAATGGATGAAAAAACAGGTACGAGTTCAATTTG<br>TTGGTTAGACTTATCTCCATGTACAAGAAATACTGC<br>CATCTCATCAATACTAGAGAGCCTTTAGTTTGCCAA<br>AAGATTGTTTCCTTGGCTTTTCTTATCTTCCTGAAGT<br>ACAGGTAGATGAAAATGCTTCATATGCTCAAATTCT<br>TATCTTACATTTGGTGTAAATCTCTTTCTGCAAAAAT<br>TTAGACAAGGCTGCTCATAGACTTGTTAACTTTGCC<br>AGTTAAAGTCCAGCAATGTTCATCTGTAAATTCAGC<br>ACTGTAACAAAAAATGGGGAAAAAAAGGACGAGC<br>ACATAAGAGTTTCTTGCTAACTGATGTACATAAGCA<br>GCGTTCTTCAAATTTTGGTTTCACCTTTGTAATTTGG<br>AATACAGATGGTAATATATCTTTCTATTTTTTTATGG<br>AGCCATTTGGTGCCTGATACAATTATTTGATCAGCA<br>CAGGGTGTTCCTGATCGAGTGAATGATGAGGTTTT<br>TATTGCAATGTCCAAGGCACTCAATTTCATAAATCC<br>TGATGAGCTATCCATGCAGTGCATTTTGATTGCTTT<br>GAACCGATTTCTTCAGGTACATCTGTTGTTGCTCTA<br>TGTGATTGTGTAATACGTATACTACTTCTGTTTGAA<br>GAAATAGTTTACATATGTTGATTCTTGCTTTCTTTTA<br>TGTATTATTTAGTTACCTGAGAAGGTTGCTAATACG<br>TATTTGCATGTGGGTATTTTGAAAAGTTTATTTTGT<br>GTATACGTGCAGGAGAAGCATGGTTCAAAAATGGC<br>ATTCTTGGATGGTAATCCACCTGAAAGGCTGTGCCT<br>GCCTATTGTTGATCACATTCGGTCTAGGGGCGGTG<br>AGGTCCGCCTGAATTCTCGTATTAAAAAGATAGAG<br>CTGAATCCTGATGGAACTGTAAAACATTTTGCACTT<br>ACCGATGGGACTCAAATAACTGGAGATGCTTATGT<br>TTGTGCTACACCAGGTGTGATTTATTACCAGTAAAC<br>CTTGTTTCCTGACTTCCTGTGCAGCTATGCAACTGA<br>ACTGACTAGTCTTCGTATTTAGTTGATATCTTCAAG<br>CTTCTTGTACCTCAAGAGTGGAGTGAAATTTCTTAT<br>TTCAAGAAGCTGGAGAAGCTGGTGGGAGTTCCTGT<br>TATCAATGTTCATATATGGTTAGTTGATCGAAATAT<br>TTGGTTCTGAATTAGAAATGCTTCATTTCCTCGTAT<br>GGTTATGCTTCTTCCTTGAGGCATTTCTGAAGCTTTT<br>CTGAGAACTTCTGTTGTTTTGAATACCTCAGGTTTG<br>ATAGAAAACTGAAAAATACGTATGACCACCTTCTTT<br>TCAGCAGGTATTCTCCTGGGCATATTTGTAGTTCAT<br>GCATTTTTTTGTGCACTATATCTTAATTATAATTGTA<br>TCAAGATATTTCATGCGTTGTTCAGGTTGCGCACAT<br>TCTACTGTTCATGTACGAATGCTCATTTTCGGTATTA<br>AATGCCATGTGTTTATTATTATTTTTTCAGGAGTTCA<br>CTGCTAAGTGTCTATGCAGA |
| 64 | Digitaria sanguinalis | Genomic | 1012 | CAATGACTTTCACATGTGCCCTATACATAAAAGGTC<br>CTACGGCTCACATGATTAAGAAGGAATTCATTATTA<br>AGTGGAAATATAAATATCTTTCGCATTAAAAATTTT<br>GATATCTGTGCTAGATGTATTGAAGTGTGGGACTT<br>TGTCATTGCGAACATGTCAGTAGTCACTGTGTTGTA<br>TTGAAGAATCATGATATATTAGGTAGCGATGGAAA<br>TATGCACACTCACCTTTTTTCTTTCCTTTTGTTGTGTA<br>ACCCTCTACAGGAATACTATGATCCAAACCGTTCAA<br>TGCTGGAGTTGGTCTTTGCTCCTGCAGAGGAATGG<br>ATTGGACGAAGTGAAACTGAAATTATTGATGCAAC<br>TATGGAAGAGCTAGCCAAGTTATTTCCTGATGAAA<br>TTGCTGCCGATCAGAGTAAAGCAAAGATCATTAAG<br>TATCATGTTGTGAAGACACCGAGGTGAGGTTATTT<br>GTCAGACACTCCTGATAGATAAGCATAAGTAGCTC<br>TAGCTCTGATAGTTTTAGTTTAGTGTTTTTTTTGTG<br>TGTGTGTGTGTGTGTTGTTTCCTTATGTTCATACT<br>CTGCCTTGCTTTGACAGATCGGTTTACAAAACTGTT<br>CCAAACTGTGAACCTTGCCGACCTCTCCAAAGGTCA<br>CCGATTGAAGGGTTCTATTTGGCTGGTGATTACAC<br>AAAGCAGAAATACTTGGCCTCCATGGAAGGTGCAG<br>TACTATCTGGGAAGCTTTGCGCCCAATCTATAGTGC<br>AGGTAAACACTCGCCACATGTTCTTGGTTGTACATA<br>AAAGCATCAGATTGCTTGTAAGTTTGATCATTTTGA |

TABLE 1-continued

Weed species and PDS gene sequences

| SEQ ID NO | SPECIES | TYPE | LENGTH | SEQ |
|---|---|---|---|---|
| | | | | TGTGGTACATTTTGGCAGCTAATGATTTAACATCTG CTGCTTTCAGGATTATAGCAGGCTCTCCCTCAGGAG CCAGAAAAGCCTGCAATCCGAAGAAGTTCCTGTCG CATCTTAGGCGTAGTTCAGGCTCCCATTCGGTGTGT CATCTTATCACCTATTTCGTGGGAACCCACCAACTG CTCATGTTGAG |
| 65 | Kochia scoparia | cDNAContig | 1995 | ATGAGTTATTTTGGATATGCTTGTGCTACCCAATCC ACTTCAAGATGTGTTCTTTTGGGCAATTCTGGTAAC CCCACTTCAGTTTCATCTCGTGGCAGTGATTTCATG GGTCATTCTGTAAGAAATTTCAGTTTTAGCAAAAGA CAGAGAATTGGGCACTGCCCATTGAAGGTTGTTTG TGTAGATTATCCAAGACCAGAGCTTGAAGGTACAG TCAATTACTTGGAAGCTGCTTATTTATCTTCAACTTT TCGGAATTCACCTCGTCCTCAAAAGCCGTTAGAGG TTGTAATTGCCGGTGCAGGAGGGAAAAGGGTAGT GATAATTACTGGGTGTTTGGCTAAGGATGTTCAGC ATAGCATGGTTGTCTCTTACAACCACACTCATGTAT TACCATGGACCCCCTTTGGAGAGGGTAAGGTGGTT TTAATTGTATCCATAGGTTTTCAAAGGGTGACAAGT GGAGGGAAATGGTTACCTTCAGGAAATGAGGGAA CAGGGAGTTGGGTCCTTGCCTTCATGGGAAAAGAG AGATTGTTAGGTTTGGCTGGTCTATCCACAGCGAA GTACTTGGCAGATGCAGGACACAAACCCATATTGC TTGAGGCACGAGATGTTTTGGGTGGAAAGCTGTTG AAGTTATTCATCATTCTGTACAATGTTAAGTCAGTG TTAATGAGGTTTAGAGGGGTTGCAGCGTGGAAAG ATGAGGATGGTGACTGGTATGAAACTGGGCTCCAT ATATTCTTTGGGGCTTATCCAAATGTGCAGAACTTG TTTGGAGAACTTGGTATCAATGACCGATTGCAATG GAAGGAACATTCTATGATTTTTGCAAGGCCTGACA AACCGGGTGAATTTAGCCGCTTTGATTTTCCTGAAG CCCTGCCTGCACCTTTAAATGGCATATGGGCAATCT TAAGGAATAATGAAATGCTAACATGGCCAGAGAAA ATCAAGTTTGCTATTGGTCTCTTACCTGCTATGGCT GGTGGACAGTCCTATGTCGAGGCACAAGATGGTTT AAGTGTTCAAGAGTGGATGAAAAAACAAGGTGTG CCTGATCGTGTTACAGATGAAGTATTCATTGCCATG TCAAAGGCACTTAACTTCATAAATCCGGATGAACTT TCGATGCAGTGTATCTTGATTGCTCTGAATCGATTT CTTCAGGAAAAGCATGGTTCAAAAATGGCTTTCTT GGATGGAAATCCTCCAGAAAGGTTATGCATGCCTA TTGTTGAGCATATTGAGTCACTAGGTGGTGAAGTG CAGCTTAACTCTCGTATTCAAAAGATAAAGTTAACT CAAGATGGAAGTGTGGATAGCTTCTTGCTAACCAA TGGGAAAGAAGTTAGAGGGGATGCTTACGTCTTTG CTACTCCAGTTGACATCCTAAAGCTACTTCTTCCTG AAGAGTGGAAAGAAATTTCATACTTCAAAAAGTTG GAGAAACTAGTAGGAGTTCCTGTCATTAATGTTCA CATATGGTTTGATAGGAAATTGAAGAATACATATG ACCACCTACTCTTCAGCAGGAGTCCTCTTTTGAGTG TCTATGCTGATATGTCAGAGACATGCAAGGAATAT TATGATCCAAACCGGTCCATGCTGGAATTGGTTTTT GCACCTGCAGAAGAATGGGTTTCTCGGAGTGACAC GGACATTATTGAGGCAACAATGAACGAACTTGCCA AGCTTTTTCCTGATGAAATCGCAGCTGATGGGAGC AAGGCTAAGATCCTAAAATATCATGTAGTCAAAAC TCCCAGGTCTGTTTATAAGACAGTTCCAAACTGTGA ACCTTGTCGACCATTGCAAAGGTCACCAATAGAAG GTTTCTATTTATCCGGTGATTACACAAAGCAAAAT ATTTGGCTTCAATGGAAGGTGCTGTCCTGTCTGGG AAGTTTTGTGCACAGGCTATTGTACAGGATTATGAT ATGCTTGTTGCTCGAGCACAAAGAGAATTGGCAGG GGCAGGCAACGCCTGA |
| 66 | Kochia scoparia | cDNAContig | 1971 | ATGAGTCATTTTGGATATGCTTGTGCTACCCAATCC ACTTCAAGATGTGTTCTTTTGGGCAATTCTGGTAAC CCCACTTCAGTTTCATCTCGTGGCAGTGATTTCATG GGTCATTCTGTAAGAAATTTCAGTTTTAGCAAAAGA CAGAGAATTGGGCACTGCCCATTGAAGGTTGTTTG TGTAGATTATCCAAGACCAGAGCTTGAAGGTACAG TCAATTACTTGGAAGCTGCTTATTTATCTTCAACTTT TCGGAATTCACCTCGTCCTCAAAAGCCGTTAGAGG TTGTAATTGCCGGTGCAGGAGGGAAAAGGGTAGT GATAATTACTGGGTGTTTGGCTAAGGATGTTCAGC |

TABLE 1-continued

Weed species and PDS gene sequences

| SEQ ID NO | SPECIES | TYPE | LENGTH | SEQ |
|---|---|---|---|---|
| | | | | ATAGCATGGTTGTCTCTTACAACCACACTCATGTAT<br>TACCATGGACCCCCTTTGGAGAGGGTAAGGTGGTT<br>TTAATTGTATCCATAGGTTTTCAAAGGGTGACAAGT<br>GGAGGGAAATGGTTACCTTCAGGAAATGAGGGAA<br>CAGGGAGTTGGGTCCTTGCCTTCATGGGAAAAGAG<br>AGATTGTTAGGTTTGGCTGGTCTATCCACAGCGAA<br>GTACTTGGCAGATGCAGGACACAAACCCATATTGC<br>TTGAGGCACGAGATGTTTTGGGTGGAAAGCTGTTG<br>AAGTTATTCATCATTCTGTACAATGTTAAGTCAGTG<br>TTAATGAGGTTTAGAGGGTTGCAGCGTGGAAAGAT<br>GAGGATGGTGACTGGTATGAAACTGGGCTCCATAT<br>ATTCTAACTTGTTTGGAGAACTTGGTATCAATGACC<br>GATTGCAATGGAAGGAACATTCTATGATTTTTGCA<br>AGGCCTGACAAACCGGGTGAATTTAGCCGCTTTGA<br>TTTTCCTGAAGCCCTGCCTGCACCTTTAAATGGCAT<br>ATGGGCAATCTTAAGGAATAATGAAATGCTAACAT<br>GGCCAGAGAAAATCAAGTTTGCTATTGGTCTCTTAC<br>CTGCTATGGCTGGTGGACAGTCCTATGTCGAGGCA<br>CAAGATGGTTTAAGTGTTCAAGAGTGGATGAAAAA<br>ACAAGGTGTGCCTGATCGTGTTACAGATGAAGTAT<br>TCATTGCCATGTCAAAGGCACTTAACTTCATAAATC<br>CGGATGAACTTTCGATGCAGTGTATCTTGATTGCTC<br>TGAATCGATTTCTTCAGGAAAAGCATGGTTCAAAA<br>ATGGCTTTCTTGGATGGAAATCCTCCAGAAAGGTT<br>ATGCATGCCTATTGTTGAGCATATTGAGTCACTAGG<br>TGGTGAAGTGCAGCTTAACTCTCGTATTCAAAAGA<br>TAAAGTTAACTCAAGATGGAAGTGTGGATAGCTTC<br>TTGCTAACCAATGGGAAAGAAGTTAGAGGGGATG<br>CTTACGTCTTTGCTACTCCAGTTGACATCCTAAAGC<br>TACTTCTTCCTGAAGAGTGGAAAGAAATTTCATACT<br>TCAAAAAGTTGGAGAAACTAGTAGGAGTTCCTGTC<br>ATTAATGTTCACATATGGTTTGATAGGAAATTGAA<br>GAATACATATGACCACCTACTCTTCAGCAGGAGTCC<br>TCTTTTGAGTGTCTATGCTGATATGTCAGAGACATG<br>CAAGGAATATTATGATCCAAACCGGTCCATGCTGG<br>AATTGGTTTTTGCACCTGCAGAAGAATGGGTTTCTC<br>GGAGTGACACGGACATTATTGAGGCAACAATGAAC<br>GAACTTGCCAAGCTTTTTCCTGATGAAATCGCAGCT<br>GATGGGAGCAAGGCTAAGATCCTAAAATATCATGT<br>AGTCAAAACTCCCAGGTCTGTTTATAAGACAGTTCC<br>AAACTGTGAACCTTGTCGACCATTGCAAAGGTCAC<br>CAATAGAAGGTTTCTATTTATCCGGTGATTACACAA<br>AGCAAAAATATTTGGCTTCAATGGAAGGTGCTGTC<br>CTGTCTGGGAAGTTTTGTGCACAGGCTATTGTACA<br>GGATTATGATATGCTTGTTGCTCGAGCACAAAGAG<br>AATTGGCAGGGGCAGGCAACGCCTGA |
| 67 | Kochia scoparia | Genomic | 12119 | AGGAAAATCTAGATGAAATCACAAAACAAAACCCA<br>CTAAACTATACTTATCCTAGAAAAGTAAAAGCATTC<br>AATTAGTGATGAGAAGCTTAAGCATACGCTGCACA<br>AAAACAACCAACTAATCAACTCATAGAAAACAGCA<br>ACTGATGTCAGTAAGTAGTTTCTAAAATTTTACCTT<br>CCTTGCAAGAGATGACCAAGCCCAACTGTCCCGAA<br>CACGGTCAGGGAAATGAGAGGAAGGCCATATCTC<br>ATAAATGGGTTCCTTCTCCCAATCTCTTTAATCCTG<br>AATACTGAAAGCCTGGAAAAGCAGCAGCTTTCTTT<br>GAATCATTAACTGGCGCTCTCGCAACGACTGTCAT<br>GTTTCTCCCTCTAAATATGACTCTGAAGTTCCAATTT<br>CACTCAGAAATTAGTTGTTCAACTTAGCAATCAAAC<br>AAATTTAACTAATTTGTAGCTTAAACACTTGTAAGA<br>ACAACATCTGGAAAACCCACATCAAGTTTTGTTCAA<br>CGAAAGCACCATAATTGATCCATAAACCAAGAAAA<br>CTGGCAAATTCATACTCCTCATCAAACATTTCGACA<br>TTCATAGTTTCAAAAAGTAGAATGATAATTTTAGAA<br>AGTCGTTTATACTTCAAAATTGCAAAGAATAAGAC<br>GCATAACGTACTGTATCCATAAACGATTGAAAAAA<br>AATAATTCATGCTTTTGATTGATATTCTGTGCCTTGT<br>AAAAATATCTGTAATAGCGCAATTAATTGACACTTG<br>CAAAAGCTCAAATCAAACGCTAAAGTTAAATCAC<br>AAATAGCAACTAATCAAATTCATAATTTGTCGAAAG<br>TATGAATGAGGTTAAAGTTACACAAAATACCTGAA<br>AATGGCGAAAATAATGCGGAAAAATCTTTATTCTTC<br>TTTAGCTCGTTCTTCTTCTGCAAGAAGCAAACTTGA<br>TTTTAGGATATGCTAATTTCGCAAACCAGAATTTAG<br>GGTTCGTTTGGTAGGGCGTAAAACGTTTTCAAATG |

TABLE 1-continued

Weed species and PDS gene sequences

| SEQ ID NO | SPECIES | TYPE | LENGTH | SEQ |
|---|---|---|---|---|
| | | | | AAAATAGTTTTCATTGAAAAACATTTTACAATTGAA |
| | | | | AACTCATTTTCATACAAGTTTTCTATTGTTTGGTTGA |
| | | | | ATGGAAAATGATACAAAAGGTTTATTGTTTTATTTT |
| | | | | TATTATCAAAATATTTTTTAAAAAATAAAATCAA |
| | | | | AATCCAGATTGATTAATAAATTAAAACGTCGAATAA |
| | | | | TGTAGCAAATAGTGTTATTGATATCAATCAATCATG |
| | | | | ATTTTGATGAAAATACAATCAAGAATTCTTAAGCAA |
| | | | | AATCTTGATGCGCGTCCACAACATCCGAAAAATAA |
| | | | | ACATTAATTTGGTTTATCAGGATGATTTCCAGAAAT |
| | | | | TTATGGAAAATCGAAATTTCAAAATCATCCAAAAA |
| | | | | TTCGCGTCAACTTTTATCAATAATCAAACATCAAAA |
| | | | | TTCAATCAATTACCTATGTAGTTGAAATATCAATCT |
| | | | | ATCCAATAATCCAGCAATAATACAATAATCAAATAC |
| | | | | TGAAATTCCAGAAAAAACATTCATCTTGTCATCTT |
| | | | | GATTGCTGCTACCATATCTTCATTAGATCTTCTTCCC |
| | | | | CAATTGATTATTAAACCAAATGAATTATTTAGGATT |
| | | | | TTTGAAATATTTGAATTGATTGTAAAAATTGAAAGA |
| | | | | AATTCGAGACCGGCAAAGAATTGAAGAAGATGGA |
| | | | | AATTCGAGGCAAAGAATTGAAGAATTGAAGAATTG |
| | | | | AAGAATTGAAGTGAAGTTGTTGAAATTGAATTGTA |
| | | | | CTGTGCGAATTCAAAAGAGAGTTATGATAGAGAAA |
| | | | | GTGTAGATGTTAGATGTCGTATGATGGCAGAAGAA |
| | | | | AGTACGAAACAAAGGAAAACCTTTTCCTTTGATTTT |
| | | | | TGAAGGAAAAGATTTTCAATTGGAATGTAAAATAA |
| | | | | TTTTACACTCAAGTTTTCCATTTTATTTTTTCAATCTT |
| | | | | ACCAAACAATGTAAAATAGGAAAATAGTTTTCAGG |
| | | | | GAAAATGTTTTACGCCCTACCAAACACTACCTTAAT |
| | | | | CTTGGCGGTTGAGAGATTTCATCTCAATAATTAAAA |
| | | | | GTATAAAATCCAAGAAGAAAAGATTACCAAAAAAC |
| | | | | TTGGAGAAAGAAATTGATTAAGAGATGATGAGATA |
| | | | | TGGCAGTACCGCGATTACCGAACAAAGATTGAAAT |
| | | | | GATGATGAGATGATGATGATGATGATGATTGATGA |
| | | | | TGATGATGATGAATTGATGATGAGCTAGCTCGAAA |
| | | | | ACGGATTTGTGCGGGTAATGGCTCAAACGATTCTG |
| | | | | AAGACTACGTTATTCATCCATTTTGGTCGCTAGTGG |
| | | | | GCATGACTTGAGTAAAATGGATTGAAGTGACGGCT |
| | | | | AGATTGGATTTGGGGCTAGCCAAGACATAAGAATC |
| | | | | GTTTGGGTTAATCGTTAACCGTTAAGAGTGGGTCG |
| | | | | AGACTAATATAGGAGCAACTTTTCGTTCGAAACCCA |
| | | | | AAAAAAAAAAACAAACAAAGCACATGATGAATA |
| | | | | CTGAATAAAAAATAATTAATTGGATCCATCTTATA |
| | | | | TGCCTAAGGCGTACCCAAAAGTCATGAAGGTTGGC |
| | | | | TGATCCTATCTACGGAATACACAATGCTTAAACAAT |
| | | | | TAAAATTAACATACTTTGTAGGTGAGGCATGCTTG |
| | | | | GTTTGATCAAATTTAGACATGAGTGACGAATTGAA |
| | | | | TCTTGCCTAATAGGATCAAACTCATGAAGTTATGAT |
| | | | | ATGACATGCACTATGGATTATTTTTTGCATGAGATT |
| | | | | TTTATAAAACTTGATATAATCTACCTAACTAATGTAT |
| | | | | GTCCTGATTGACATTTGAGTTGTCCAATAACGTACC |
| | | | | ACGACATCAATTCAAGAGTTCTTCGAAGAAAATAA |
| | | | | GTAAATAACCCCAATCTCAAGGATAAGGAGATTTG |
| | | | | AAGGCTAAAAAAACTTGATCTACCCATTGAGTAGA |
| | | | | CTACCCACCATTAATTGACAGTGGTAAAAAGTGGT |
| | | | | GACAATAGAATTACACTCAAGTTATGAAACAATAG |
| | | | | ATATGTATATGCGATCCATTAAGTAAATGTAATCAT |
| | | | | GTCCGAGCCGAAGGGATCAAGCCTAGACACCAGTC |
| | | | | AAGCTTGGGTTGGTAAAATGGTGAAGTACTTCGTA |
| | | | | TGTATTGAAGTATTGTAAGTACATGAGTAACCGCA |
| | | | | AAGGCTCTAAAGCTACTACTACTACTCCTAATT |
| | | | | GGGTAACCGCAATATGTGTGGACAGTTCGAAAGCC |
| | | | | ACACAATTTGAGTGGCATTTTCCATTTTTCAATTCTC |
| | | | | CTCTCTCTCTCTCAGTGGCTCAAACAGAAATCGC |
| | | | | ATTACACCCACATTCCACAAATGGCCCTTTGATAAA |
| | | | | GCACTAAACCTACTCTACTCCTACACTCCTTCATCTA |
| | | | | ATCTCAATTTCCGTTACTTCTTTGGTTCTATTGCACA |
| | | | | CCCTTTTACACCCATTGCAGTTTATATTCCACTGAAT |
| | | | | TTCGTATTGCAAACCCAATTTACAAAAATTGCAGAA |
| | | | | GAAAATGAGTTATTTTGGATATGCTTGTGCTACCCA |
| | | | | ATCCACTTCAAGATGTGTTCTTTTGGGCAATTCTGG |
| | | | | TAACCCCACTTCAGTTTCATCTCGTGGCAGTGATTT |
| | | | | CATGGGTCATTCTGTAAGAAATTTCAGTTTTAGCAA |
| | | | | AAGACAGAGAATTGGGCACTGCCCATTGAAGGTTC |
| | | | | TATTGCTTGCTTTCTTGTTTATGGATCAATTTTATGG |
| | | | | GATTTGATGAAAAGATTAGATTTGTTTATAGTTGA |
| | | | | ATTAATCGAGAATTTTAATGTATGATGCAGGTTGTT |

TABLE 1-continued

Weed species and PDS gene sequences

| SEQ ID NO | SPECIES | TYPE | LENGTH | SEQ |
|---|---|---|---|---|
| | | | | TGTGTAGATTATCCAAGACCAGAGCTTGAAGGTAC |
| | | | | AGTCAATTACTTGGAAGCTGCTTATTTATCTTCAAC |
| | | | | TTTTCGGAATTCACCTCGTCCTCAAAAGCCGTTAGA |
| | | | | GGTTGTAATTGCCGGTGCAGGTAAGTGGGATGTTT |
| | | | | CCTGTAACTTGCTTTGTTCATTAGTTTCTTGTTCTTTT |
| | | | | GCTTGTTGCTTTATAAACTAGTGATGTTTGGTATGT |
| | | | | GTTTGGTGTAATCATTGTCTTACTGATATGGAAAGG |
| | | | | ATTATGTAGGAGGGAAAAGGGTAGTGATAATTACT |
| | | | | GGGTGTTTGGCTAAGGATGTTCAGCATAGCATGGT |
| | | | | TGTCTCTTACAACCACACTCATGTATTACCATGGTA |
| | | | | AGGGTTGTACTTAGAAAATTGTTGTATTTGGCAATT |
| | | | | GGCAATACAATGGAATTGAACCATATTTCATGAAG |
| | | | | GACCCCCTTTGGAGAGGGTAAGGTGGTTTTAATTG |
| | | | | TATCCATAGGTTTTCAAAGGGTGACAAGTGGAGGG |
| | | | | AAATGGTTACCTTCAGGAAATGAGGTTTGTTCCTAC |
| | | | | ACTTACACCAAATGGTGTGCAATTACACCTTAAAAT |
| | | | | CCATTACCAAACACCCTTAGGTTTCGGTTTATCATCT |
| | | | | GTTAGAGGCCTACCAATGAGAATTTCCCTTACGTTA |
| | | | | ATGAAGTAATGGGTTTTGACACCTTTTTTTTTTATGT |
| | | | | TGCATGTTCGAAATAAGCTTTGTAGTTTGAAGTAGC |
| | | | | TTACGGCTAATAGCTGTTATGCGGGAATATTGTGA |
| | | | | ATTGGAAAAGAATAAGAGAGTACTTGCTTCAAGG |
| | | | | ATCATAAGGTTTATGATTGTTGGAATCATCTTTAGT |
| | | | | GAAATTTTGATTTTCAACTGATCTCTACGGTAACTA |
| | | | | TTGGTCCTTCAAAATTCTAGACGCAGAATCGTTTAG |
| | | | | GTGAGGGTGAACTCTGATTATGAATAGTCAATGTC |
| | | | | TCTCCCAACGTGAAACTTATTAGTTCTAGCTGTTAT |
| | | | | GTGCTCCAATTCGAGGAACATCGTGAATTGGAGAA |
| | | | | AGAATACTGCTTCAAGGATCATGAGTTTATGATTGT |
| | | | | CGTAAACTTCTCTTAGTTCTTTAGTGAAATTTCAGC |
| | | | | AGATTTTAATGGTAATTAGCAGTCCTTCAAAATCCT |
| | | | | AGATGCGGAATCATCTAGGGCATGTATATGGTAAA |
| | | | | CTCTCATGATAGATAACTAGTGTCTCCTCCATGTAA |
| | | | | ACTTTATTAGGTATTTTCTTTGTCAAAAAGAGTATTT |
| | | | | TTCATTGGAAAAACAATATAATGGTGACTACTGCAT |
| | | | | ATGTTTGGTTAGCTATTCCTGTTGCAAATCAGATTT |
| | | | | TGAATGGAACATGTCTTATTCCCTTCTAGAGCTCTC |
| | | | | CTGGTGCAATTCTAGCATTTTCCCCTCAATAAGTGG |
| | | | | TATTTGAGCTAATATTTCAAGTCTAGACATTATAGC |
| | | | | ATGCTATAATGAGGCGGAATTGTTTGAGCCATGTT |
| | | | | AAAGGGTTCCATGACATGTAATATGCTAGTTTATG |
| | | | | GCAGGGAACAGGGAGTTGGGTCCTTGCCTTCATGG |
| | | | | GAAAAGAGAGATTGTTAGGTATTTCTTAAGTTTGC |
| | | | | ATGGGAAAGAGTTCTTTTATCTTTATAGTGAAAGTT |
| | | | | GACTAGTATGCAAGTATGGTGGTGGATTACCCTTA |
| | | | | TTGCCATTTGGACTTGTATGCTATTTAGTGCATATA |
| | | | | CTTCAGCCTAGCTTAATCTTGACAAAAATGCCTTGA |
| | | | | GTTCTAGTGGTTTGCTTTATTCATTGGTTGATTTGCT |
| | | | | ATTTCTGCTAGTGAAATTAGAGAGAAAATTGATGC |
| | | | | CTGTTTCAGTGTTTCTCATCAAGGTAAATGGACAAA |
| | | | | ACTGTCTATGTCTTGAAATTTTCTGTGAATACTCAA |
| | | | | GCAGGCTTCCTTGGTTTGCTTCAGGCTGATTTTCAT |
| | | | | TGCCTCAGTTTCTGCTTGTTGGTATCAGAATAAAAA |
| | | | | TAGATACTTTTATGTATTTGTGAGAGATTTGTTGGT |
| | | | | AGAACCACATTTATTCTGAGAAATATTTGTACAAAT |
| | | | | GGGAGTTTAAGGTTATAAGTGTGTAAGCCTTTTGA |
| | | | | GGTATTTTGTTTTAAAAATCTTATCGTTATTTCAGAG |
| | | | | CAGCAAGTTACATATAGTAAACTTGGGAGCATTGG |
| | | | | AGATGTGATGGAATTAGATTCAATATATTTTATCAT |
| | | | | CAAGATATGAGTTCTAATTCAAAACTTTCCTTCTAG |
| | | | | GTTTGGCTGGTCTATCCACAGCGAAGTACTTGGCA |
| | | | | GATGCAGGACACAAACCCATATTGCTTGAGGCACG |
| | | | | AGATGTTTTGGGTGGAAAGGTATGTGCTTATATGC |
| | | | | TATTTTTTCAGAAATATATCCTTTGTGCTTCTTCTCTT |
| | | | | CTCAGTTTATGTTGACTATAATAAATGAAACAGCTT |
| | | | | AATTGTCTTGGTTGTATGCTTTCATAGTATTATCTAG |
| | | | | GCTACATGGTTATACGGACATATATTATTGAGTGG |
| | | | | AGTGATTTAGTCATCTTAAGTGGTTATTTACTTTTAT |
| | | | | TTTATAGCTGTTGAAGTTATTCATCATTCTGTACAAT |
| | | | | GTTAAGTCAGTGTTAATGAGGTTTAGAGGGTAATG |
| | | | | GACTAATAGACAAGCTTTGTGCTGTGAACGGTTTG |
| | | | | AGAACATGTGCTATTGGGACTGATGTTATGCAATG |
| | | | | TTTGTGGTAGTCTTCCTTCTTATGCATTTGTTTATTG |
| | | | | TTACTGTTTCACAGGGTTGCAGCGTGGAAAGATGA |
| | | | | GGATGGTGACTGGTATGAAACTGGGCTCCATATAT |

TABLE 1-continued

Weed species and PDS gene sequences

| SEQ ID NO | SPECIES | TYPE | LENGTH | SEQ |
|---|---|---|---|---|
| | | | | TCTGTGAGTATAATATTTTGCTTTTCAGCTTAGATAT
CCTGTTTAAGCTTCTAGTCCTACAATTTATGTTTTCT
GCTGAGTGGATTTTTGTAAAAGTTTTACGGGATCT
GTGCAATTTCTGCCTTCTGATTCTGTTATTATTTGGA
AGGGCGTGATATTGTGACAATTTCAAAGTGGTTTC
ACTCCAGACAAAAGTCAAACTAACAATTCAATGTAC
TGAATACCCTTTTATTTTCTTGAAGTTGGGGCTTATC
CAAATGTGCAGAACTTGTTTGGGAGAACTTGGTATC
AATGACCGATTGCAATGGAAGGAACATTCTATGAT
TTTTGCAAGGCCTGACAAACCGGGTGAATTTAGCC
GCTTTGATTTTCCTGAAGCCCTGCCTGCACCTTTAA
ATGGTGAGTATTTGACACCTTATATTCTTTAGCAAA
CTAAGTATTGTATAAGCCAAACTGCACCTGGTGAC
ATTCATTGATTTCTTTCTTGCTCACCGACTTTCCTTG
AGATTCTAGCAACATCTTATTCTCCGTCTTCTAATGA
GTAAACTAGTTTTGATTCTGTTCATTCTTAATGTGTT
TGGCAGGCATATGGGCAATCTTAAGGAATAATGAA
ATGCTAACATGGCCAGAGAAATCAAGTTTGCTAT
TGGTCTCTTACCTGCTATGGCTGGTGGACAGTCCTA
TGTCGAGGCACAAGATGGTTTAAGTGTTCAAGAGT
GGATGAAAAAACAAGTAGGAACAAACGATCATTTT
TAAAACCTTATTTTCAAATTCCTTGATGATTGTCTA
GATTGTTAGTTCATTACATGTCTAACTTTAAACATT
GATGTTACAGGGACATCTATTTTATTTATTTTTGAA
AATTCCTTTTGCAAATTTTGTAGGGTGTGCCTGATC
GTGTTACAGATGAAGTATTCATTGCCATGTCAAAG
GCACTTAACTTCATAAATCCGGATGAACTTTCGATG
CAGTGTATCTTGATTGCTCTGAATCGATTTCTTCAG
GTATAGCCCCATTTCACTATCTGCTTTAAGTGTGTTT
TATTTTCAATTGAATTCGACCTGCTCAACTATATGG
AACTTAAGTAATTTTGATTTGAACTTATTGATACAA
ACGTATCAAAACTTACGATAATCTTTTTCAGTTTGA
TACACTATCGTTTTGTTTCTGAGAACTTTTTGTAAAT
TGGATTATATGTGATGTTAAAATTATGGAATTCACT
CAACAGGAAAAGCATGGTTCAAAATGGCTTTCTT
GGATGGAAATCCTCCAGAAAGGTTATGCATGCCTA
TTGTTGAGCATATTGAGTCACTAGGTGGTGAAGTG
CAGCTTAACTCTCGTATTCAAAAGATAAAGTTAACT
CAAGATGGAAGTGTGGATAGCTTCTTGCTAACCAA
TGGGAAAGAAGTTAGAGGGGATGCTTACGTCTTTG
CTACTCCAGGTTTACTTTTCTTCTTTACCGAATGGGA
TTATTATTCAACTAGGAAATTATTGCCATTTTTAGTC
AAGACAGGCTCCTGAAGAAATTATTTATTGCCATCT
GTATTGTTCTCTGATATACCTTTAAATTTTTATTACA
GTTGACATCCTAAAGCTACTTCTTCCTGAAGAGTGG
AAAGAAATTTCATACTTCAAAAAGTTGGAGAAACT
AGTAGGAGTTCCTGTCATTAATGTTCACATATGGTT
AGTGATACCTCTTGTCTACAGGAATATAGTTTCTTA
ATGCTATAACCCAATCTTATGTGTCTTCTCTTACTCT
ATGTAATTTTATTTATGTATCTATCTTTCTCTTTCCAT
GTCCATGTATTTTGTTATTTCTGTCTTTGGCTTTTTA
GAATGGTTTGTCAGTATATCTTTGCAATTAGGCTCT
GATTTAATAGCCTACTACTATACGAAGTATATCATT
TCTTTGGTAGTATATTTTCTGTAGTTTGCGTTGAGA
GTTTGAGACTCCTATACGTAGAGCTTCATCTTAATA
AAATTTTATGTCTTGTAAAATCTGTCTGTTTTGAAAT
GTCAAAAAAGCTGTCAAAAGCTATTTCTCACCCTCT
CCTTATGAAGAACTTCAATGAAATCTCCTCTAATAT
TGGGACTGACATTTAACAACTGTTGGCTTGCAGGT
TTGATAGGAAATTGAAGAATACATATGACCACCTA
CTCTTCAGCAGGTGTGTTCAATTAAAGTGCTAAATT
CAATATCATTTTCATAGCACTCAAACAATACTCAAA
GATTATCCTTCCCTTTTTGTCCTTGTTTTATACTCATT
TCGTTTTCCCTTTTTTTGTTGGAAAGCACATTTTGTT
GAGCATATGCCATGAGCTGCATACTTGCATAAAAT
TGGGCAAAGGAGCCACAGTCATTTGATATGAAGTA
TGATTTAAGAATCCTCCTATGAAGTTAGAAAAGTTA
TGGTACTAGTTTTCTTTTACTGAGTGAACGGGGTAT
CCCTGCCAGCAATGTGTACAAGGATACTGGCTTGC
TGCAGAAAGATACTTTCAGTATTGATAAGATACAA
ATTGCATTTTCTTTTGGATGAAATACAGTGAACTG
GCAATGGTGTCAGCTTGAACGTTGAGAATCCTTGA
TATCCATTTGATTCATGTTTTCACTTGTGCGTGGATT
TCACTCCTATAAGTTTGTCATTGCAGGAGTCCTCTTT
TGAGTGTCTATGCTGATATGTCAGAGACATGCAAG |

TABLE 1-continued

Weed species and PDS gene sequences

| SEQ ID NO | SPECIES | TYPE | LENGTH | SEQ |
|---|---|---|---|---|
| | | | | GTAATTTCTCCTCAATTTTGTTCTTCATCATGTAATA |
| | | | | CATGCTGTCTCATTCGCAAACGTCTACTATGTGCTA |
| | | | | TTCAATCGAAGGCATATGTAATGTTATTTAATCAAA |
| | | | | AGCATATACTGTATATAAGTGCTTTGTCACTTCCAA |
| | | | | AACTATGTCTGTTTTTTAATCCCCTATCGATTTTTTT |
| | | | | ATTTGTTATTTATTTCTTAATTGTTTTGTTAGCTTGTT |
| | | | | ATATGTTTGTCTTTGAGACTTTTTGGTTGTTATCATT |
| | | | | GAACATCTTTATGACTTACTCCTTTCGGAATCAAGT |
| | | | | TACACATACAATGAAAGTGTGTATGATTAAATTTGT |
| | | | | CAATAGGCTATTATTTGTTTGAGTGATGAGGAGAT |
| | | | | GATAACTTTATTCCTACTATAAAGAAAAGGTCTACT |
| | | | | TTAAAACCTCGTCTTGTCATTAATTATGAGGGTTGG |
| | | | | ATGTTGGGATTGAGATAAATCAACTGATACCAGAA |
| | | | | CCCAGAAGGGGAAAATGCAGAAATACTACCTCATG |
| | | | | AGCTGTGGCTGACCTTTCTGTTCCCATGATCTTGTC |
| | | | | TTATTCTATGAGTATGAACTAAAGTAGTAGAGTGTT |
| | | | | CCCAATCTTTTGGAGCGTACAGGAATATTATGATCC |
| | | | | AAACCGGTCCATGCTGGAATTGGTTTTTGCACCTGC |
| | | | | AGAAGAATGGGTTTCTCGGAGTGACACGGACATTA |
| | | | | TTGAGGCAACAATGAACGAACTTGCCAAGCTTTTTC |
| | | | | CTGATGAAATCGCAGCTGATGGGAGCAAGGCTAA |
| | | | | GATCCTAAAATATCATGTAGTCAAAACTCCCAGGTG |
| | | | | AGATAATATGTACTATACTGCTCTGTATTAGTTAGA |
| | | | | TTTGGTAATCGTTTGTGGTATTAAGCAGACCTTATC |
| | | | | TGCTGAAAAGCAGTATCGATATTTACTACTGTTAAG |
| | | | | GTCTCTAACTGTTAATTCTTCCATTCCTTCACAGGTC |
| | | | | TGTTTATAAGACAGTTCCAAACTGTGAACCTTGTCG |
| | | | | ACCATTGCAAAGGTCACCAATAGAAGGTTTCTATTT |
| | | | | ATCCGGTGATTACACAAAGCAAAAATATTTGGCTTC |
| | | | | AATGGAAGGTGCTGTCCTGTCTGGGAAGTTTTGTG |
| | | | | CACAGGCTATTGTACAGGTAATGAGGTTTTGCTCA |
| | | | | AACATCATAAGCATGATATTCATGAGTTTCACTTCC |
| | | | | TATATCTCCTAGAATCCTCATGATATTGTTACTCTAT |
| | | | | AAATTATGTTTACTGAAAATTTAGTCCTATTATTCAT |
| | | | | TTGCAGGATTATGATATGCTTGTTGCTCGAGCACAA |
| | | | | AGAGAATTGGCAGGGGCAGGCAACGCCTGATTTG |
| | | | | AAATTCTTTGATATTTGCCCATTTTTTTCGTCGGAGA |
| | | | | TTTGGATTGGTGATCTTGTTCAGATCGAGTTCAGAT |
| | | | | CGATATTCAACTACTGGAAACAAACTCTGGGAAGC |
| | | | | ATTCTCAGTTATACTCAATTTTTTTTCTGCTGTTCA |
| | | | | AGATGTATATGTGTAGCTTAATTGTAGGGAAACAT |
| | | | | GTACAGGCATGTACTCATAAGTGGTTTCAAATGTA |
| | | | | AGTAGTAATTCAATACATGTACTAACATTTCTGTGG |
| | | | | AAATAGGAAACTGTTTTAGAAGAGTGTCCCCTTTCT |
| | | | | ACTTCGTAAATGACATTTAGATTGTGGCTTTGTTGC |
| | | | | TGGGAGCATGGTCCGGCTTGGTTAGGAAGCACGA |
| | | | | GGCCATTGCCCGAATGCCGCCAATGTGGATTGATG |
| | | | | GATCTTCTCTTAGCTTCTTAAGGGGTTAGTCTTTTTC |
| | | | | CATGATACTTCCTCAGTTATTGAAAGAATGTAAACC |
| | | | | TTTTTTTTTTTTTCATTTTGTCGTGAAACTTCGCAAT |
| | | | | TTTCAATCTTATACGTGTATGAAACTTCGATATTACT |
| | | | | TCTCCATATTTTTAATCACAACACGTATGGATTGCC |
| | | | | GGATTGGCAATAAAGTTGATGATAGAGAAAATATG |
| | | | | TGGGGGCATATGAAATTCTTGTGAGAGTAAAGTGG |
| | | | | TGGTCTTGTATACCATTTTAAAAACGTCGTAAACAT |
| | | | | TTTGAATCAACTCAAAAATATAAAAAGTGTCCCCTT |
| | | | | TATACTTCATTCATTTGCATTTGGACATCCCTTTCAA |
| | | | | ATATTGCTAAGCTTAGCTTAGCGATTAGGGTTGAA |
| | | | | CCTTTTAACCTTGAGGATGCAGGTTAAATTTTTACT |
| | | | | AAAGCATTTCGGGGTTTTTCTATTATTACTCTTTCCC |
| | | | | CCCTACTTTTAAAGCGTCTAGTCATCAAACTTACAG |
| | | | | CGGATCGATGTTTGAATACGATAACGTTATCCTACA |
| | | | | AAAAGAAGAAAGGGTACCTCAACCCCAATTCCCC |
| | | | | AAGACCTACTCCCAAAGTCCAAAACAACATGAGTG |
| | | | | GATTTGCAAGTTGCAAATAGGCATTAGGCATATAT |
| | | | | TATTTGGGCAAAATAGTAGTAATTGGAGTTGCGTT |
| | | | | GTGCATTCTTTGAAGATTAACTACTTGAGTGTGCGT |
| | | | | GCAGTCGGTGCCGTCAGTAACAAACTACATACACA |
| | | | | TCACATCTCGAGGGATGAACCCCCCATTAAGCTACT |
| | | | | CTACAAGAACCATGAACCTCCATGGGACACCCAC |
| | | | | ACTATGCTACTAAGCAAAATCCTTAACATCCTCGAC |
| | | | | TAGATATATACTTCTTCCGTTTCTTTTTACTGTAAAT |
| | | | | GCAACAAAAGTATCTTTTTGTTTTCACAAATGTCGA |
| | | | | TTTGGCTTGTAAAGCTTGTGAATTGGCTCGATTTTT |
| | | | | ATTTTTCTTTCGCAATTTCATAAAACTCGTTACACTT |

TABLE 1-continued

Weed species and PDS gene sequences

| SEQ ID NO | SPECIES | TYPE | LENGTH | SEQ |
|---|---|---|---|---|
| | | | | TTCATTCTAAGATGGTCTCACATTACTTGTTATACTT |
| | | | | TTTTTTTTTTGTAATAAACTATTTATTATATATCTCTT |
| | | | | CTCACATGAGTCCTCCTTGCTTTTTTATTCTCTATCTC |
| | | | | CTCCCTCTCCAAAAATCAGTGAATTGAGAAATGTAG |
| | | | | CGAGTAATATGAAACGGAAGAAGTACTTTGGAAAA |
| | | | | CATTTGTACTATCAATACATACATGAAAACAATGAT |
| | | | | CCTATCTATTACATATATGACAAGATTAAGAAATTC |
| | | | | ACTGTCTATTAAAACCAACAAATTGAATATTAATTG |
| | | | | AAGAAGAAAAGAAAAACATAAAAACTGAAGGTAA |
| | | | | TAATGTACTGTATAAAACTTGTTCATGAATAGTTTG |
| | | | | AAAAAAG |
| 68 | Kochia scoparia | Genomic | 10701 | AATGCTTAAACAATTAAAATTAACATAATTTGTAGG |
| | | | | TGAGGCATGCTAGGTTTGATCAAATTTAGACATGA |
| | | | | GTGACGAATTGAGTCTTGCCTAATAGGATCAAACT |
| | | | | CATGATATGACATGCACTATGGATTATTTTGCATGA |
| | | | | GATTTTTATAAAACTTGATATAATCTACCTAACTAAT |
| | | | | GTATGTCCTGATTGACATTTGAGTTGTCCAACAACG |
| | | | | TGCCACGACATCAATTCAAGAGTTCTTCGAAGAAA |
| | | | | ATAAGTAAATAACCCCAATCTCAAGGATAAGGAGA |
| | | | | TTTGAAGGGTAAAAAAACTTGATCTACCCATTGAG |
| | | | | TAGACTACCCACCATTAATTGACAGGGTAGAAAGT |
| | | | | GGAAAATTCCTAGTCAATCCAATGGATTGATAATCC |
| | | | | AATGGCATTTTGGTAAATAAATGGAAAAAAAGAAA |
| | | | | AAAATAAATGGCAATGTTGTAAATAAAATATTTCAT |
| | | | | TTATTTACTAAAATACCATTGAATTGACAATTTTTGT |
| | | | | CAATCCATTGGATGGACTAGGCATCCCTCGTAGAA |
| | | | | AGTGGTGACAATAGAATTTCACTCAAGTTATAAAC |
| | | | | AATAGATATGTGTATGCGATCCATTAGGTAAATGT |
| | | | | AATCATGTCCGAGCCGAAGGGATCAAGCCTAGACA |
| | | | | CTAGTCAAGCTTGGGTTGGTAAAATGGTAAACACT |
| | | | | TCGTATGTATTGAAGTATTGTAAGTACATGAATAAC |
| | | | | CGTAAAGGCTCTAAAGCTACTACTACTACTAATTGG |
| | | | | GTAACCGCAATATGTGTGGACAGTTCGAAAGCCAC |
| | | | | ACAATTTGAGTGGCATTTTCCATTTTTCAATTCTCTC |
| | | | | TCTCTCTCAGTGGCTCAAACAGAAATCGCATTACAC |
| | | | | CCACATTCCACAAATGGCCCTTTGATAAAGCACTAA |
| | | | | ACCTACTCTACTCCTACACTCCTTCATCTAATCTCAA |
| | | | | TTTCCGTTACTTCTTTGGTTCTATTGCACACCCTTTT |
| | | | | ACACCCATTGCAGTTTATATTCCACTGAATTTCGTAT |
| | | | | TGCAAACCCAATTTACAAAAATTGCAGAAGAAAAT |
| | | | | GAGTCATTTTGGATATGCTTGTGCTACCCAATCCAC |
| | | | | TTCAAGATGTGTTCTTTTGGGCAATTCTGGTAACCC |
| | | | | CACTTCAGTTTCATCTCGTGGCAGTGATTTCATGGG |
| | | | | TCATTCTGTAAGAAATTTCAGTTTTAGCAAAAGACA |
| | | | | GAGAATTGGGCACTGCCCATTGAAGGTTCTATTGC |
| | | | | TTGCTTTCTTGTTTATGGATCAATTTTGTGGGATTTG |
| | | | | ATGAAAAGATTAGATTTTGTTTATAGTTGAATTAAT |
| | | | | CGAGAATTTTAATGTATGATGCAGGTTGTTTGTGTA |
| | | | | GATTATCCAAGACCAGAGCTTGAAGGTACAGTCAA |
| | | | | TTACTTGGAAGCTGCTTATTTATCTTCAACTTTTCGG |
| | | | | AATTCACCTCGTCCTCAAAAGCCGTTAGAGGTTGTA |
| | | | | ATTGCCGGTGCAGGTAAGTGGGATGTTTCCTGTAA |
| | | | | CTTGCTTTGTTCATTAGTTTCTTGTTCTTTTGCTTGTT |
| | | | | GCTTTATAAACTAGTGATGTTTGGTATGTGTTTGGT |
| | | | | GTAATCATTGTCTTACTGATATGGAAAGGATTATGT |
| | | | | AGGAGGGAAAAGGGTAGTGATAATTACTGGGTGT |
| | | | | TTGGCTAAGGATGTTCAGCATAGCATGGTTGTCTCT |
| | | | | TACAACCACACTCATGTATTACCATGGTAAGGGTTG |
| | | | | TACTTAGAAAATTGTTGTATTTGGCAATTGGCAATA |
| | | | | CAATGGAATTGAACCATATTTCATGAAGGACCCCCT |
| | | | | TTGGAGAGGGTAAGGTGGTTTTAATTGTATCCATA |
| | | | | GGTTTTCAAAGGGTGACAAGTGGAGGGAAATGGT |
| | | | | TACCTTCAGGAAATGAGGTTTGTTCCTACACTTACA |
| | | | | CCAAATGGTGTGCAATTACACCTTAAAATCCATTAC |
| | | | | CAAACACCCTTAGGTTTCGGTTTATCATCTGTTAGA |
| | | | | GGCCTACCAATGAGAATTTCCCTTACGTTAATGAAG |
| | | | | TAATGGGTTTTGACACCTTTTTTTTTTATGTTGCATG |
| | | | | TTCGAAATAAGCTTTGTAGTTTGAAGTAGCTTACGG |
| | | | | CTAATAGCTGTTATGCGGGAATATTGTGAATTGGA |
| | | | | AAAAGAATAAGAGAGTACTTGCTTCAAGGATCATA |
| | | | | AGGTTTATGATTGTTGGAATCATCTTTAGTGAAATT |
| | | | | TTGATTTTCAACTGATCTCTACGGTAACTATTGGTC |
| | | | | CTTCAAAATTCTAGACGCAGAATCGTTTAGGTGAG |
| | | | | GGTGAACTCTGATTATGAATAGTCAATGTCTCTCCC |

TABLE 1-continued

Weed species and PDS gene sequences

| SEQ ID NO | SPECIES | TYPE | LENGTH | SEQ |
|---|---|---|---|---|
| | | | | AACGTGAAACTTATTAGTTCTAGCTGTTATGTGCTC |
| | | | | CAATTCGAGGAACATCGTGAATTGGAGAAAGAATA |
| | | | | CTGCTTCAAGGATCATGAGTTTATGATTGTCGTAAA |
| | | | | CTTCTCTTAGTTCTTTAGTGAAATTTCAGCAGATTTT |
| | | | | AATGGTAATTAGCAGTCCTTCAAAATCCTAGATGC |
| | | | | GGAATCATCTAGGGCATGTATATGGTAAACTCTCA |
| | | | | TGATAGATAACTAGTGTCTCCTCCATGTAAACTTTA |
| | | | | TTAGGTATTTTCTTTGTCAAAAAGAGTATTTTTCATT |
| | | | | GGAAAAACAATATAATGGTGACTACTGCATATGTT |
| | | | | TGGTTAGCTATTCCTGTTGCAAATCAGATTTTGAAT |
| | | | | GGAACATGTCTTATTCCCTTCTAGAGCTCTCCTGGT |
| | | | | GCAATTCTAGCATTTTCCCCTCAATAAGTGGTATTT |
| | | | | GAGCTAATATTTCAAGTCTAGACATTATAGCATGCT |
| | | | | ATAATGAGGCGGAATTGTTTGAGCCATGTTAAAGG |
| | | | | GTTCCATGACATGTAATATGCTAGTTTATGGCAGG |
| | | | | GAACAGGGAGTTGGGTCCTTGCCTTCATGGGAAAA |
| | | | | GAGAGATTGTTAGGTATTTCTTAAGTTTGCATGGG |
| | | | | AAAGAGTTCTTTTATCTTTATAGTGAAAGTTGACTA |
| | | | | GTATGCAAGTATGGTGGTGGATTACCCTTATTGCC |
| | | | | ATTTGGACTTGTATGCTATTTAGTGCATATACTTCA |
| | | | | GCCTAGCTTAATCTTGACAAAAATGCCTTGAGTTCT |
| | | | | AGTGGTTTGCTTTATTCATTGGTTGATTTGCTATTTC |
| | | | | TGCTAGTGAAATTAGAGAGAAAATTGATGCCTGTT |
| | | | | TCAGTGTTTCTCATCAAGGTAAATGGACAAAACTGT |
| | | | | CTATGTCTTGAAATTTTCTGTGAATACTCAAGCAGG |
| | | | | CTTCCTTGGTTTGCTTCAGGCTGATTTTCATTGCCTC |
| | | | | AGTTTCTGCTTGTTGGTATCAGAATAAAAATAGATA |
| | | | | CTTTTATGTATTTGTGAGAGATTTGTTGGTAGAACC |
| | | | | ACATTTATTCTGAGAAATATTTGTACAAATGGGAGT |
| | | | | TTAAGGTTATAAGTGTGTAAGCCTTTTGAGGTATTT |
| | | | | TGTTTTAAAAATCTTATCGTTATTTCAGAGCAGCAA |
| | | | | GTTACATATAGTAAACTTGGGAGCATTGGAGATGT |
| | | | | GATGGAATTAGATTCAATATATTTTATCATCAAGAT |
| | | | | ATGAGTTCTAATTCAAAACTTTCCTTCTAGGTTTGG |
| | | | | CTGGTCTATCCACAGCGAAGTACTTGGCAGATGCA |
| | | | | GGACACAAACCCATATTGCTTGAGGCACGAGATGT |
| | | | | TTTGGGTGGAAAGGTATGTGCTTATATGCTATTTTT |
| | | | | TCAGAAATATATCCTTTGTGCTTCTTCTCTTCTCAGT |
| | | | | TTATGTTGACTATAATAAATGAAACAGCTTAATTGT |
| | | | | CTTGGTTGTATGCTTCATAGTATTATCTAGGCTAC |
| | | | | ATGGTTATACGGACATATATTATTGAGTGGAGTGA |
| | | | | TTTAGTCATCTTAAGTGGTTATTTACTTTTATTTTAT |
| | | | | AGCTGTTGAAGTTATTCATCATTCTGTACAATGTTA |
| | | | | AGTCAGTGTTAATGAGGTTTAGAGGGTAATGGACT |
| | | | | AATAGACAAGCTTTGTGCTGTGAACGGTTTGAGAA |
| | | | | CATGTGCTATTGGGACTGATGTTATGCAATGTTTGT |
| | | | | GGTAGTCTTCCTTCTTATGCATTTGTTTATTGTTACT |
| | | | | GTTTCACAGGTTGCAGCGTGGAAAGATGAGGATG |
| | | | | GTGACTGGTATGAAACTGGGCTCCATATATTCTGT |
| | | | | GAGTATAATATTTTGCTTTTCAGCTTAGATATCCTGT |
| | | | | TTAAGCTTCTAGTCCTACAATTTATGTTTTCTGCTGA |
| | | | | GTGGATTTTTGTAAAAGTTTTACGGGATCTGTGCAA |
| | | | | TTTCTGCCTTCTGATTCTGTTATTATTTGGAAGGGC |
| | | | | GTGATATTGTGACAATTTCAAAGTGGTTTCACTCCA |
| | | | | GACAAAAGTCAAACTAACAATTCAATGTACTGAAT |
| | | | | ACCCTTTTATTTTCTTGAAGTTGGGGCTTATCCAAAT |
| | | | | GTGCAGAACTTGTTTGGAGAACTTGGTATCAATGA |
| | | | | CCGATTGCAATGGAAGGAACATTCTATGATTTTTGC |
| | | | | AAGGCCTGACAAACCGGGTGAATTTAGCCGCTTTG |
| | | | | ATTTTCCTGAAGCCCTGCCTGCACCTTTAAATGGTG |
| | | | | AGTATTTGACACCTTATATTCTTTAGCAAACTAAGT |
| | | | | ATTGTATAAGCCAAACTGCACCTGGTGACATTCATT |
| | | | | GATTTCTTTCTTGCTCACCGACTTTCCTTGAGATTCT |
| | | | | AGCAACATCTTATTCTCCGTCTTCTAATGAGTAAAC |
| | | | | TAGTTTTGATTCTGTTCATTCTTAATGTGTTTGGCAG |
| | | | | GCATATGGGCAATCTTAAGGAATAATGAAATGCTA |
| | | | | ACATGGCCAGAGAAAATCAAGTTTGCTATTGGTCT |
| | | | | CTTACCTGCTATGGCTGGTGGACAGTCCTATGTCGA |
| | | | | GGCACAAGATGGTTTAAGTGTTCAAGAGTGGATGA |
| | | | | AAAAACAAGTAGGAACAAACGATCATTTTTAAAAC |
| | | | | CTTATTTTTCAAATTCCTTGATGATTGTCTAGATTGT |
| | | | | TAGTTCATTACATGTCTAACTTTAAACATTGATGTTA |
| | | | | CAGGGACATCTATTTATTTATTTTTGAAAATTCCTT |
| | | | | TTGCAAATTTTGTAGGGTGTGCCTGATCGTGTTACA |
| | | | | GATGAAGTATTCATTGCCATGTCAAAGGCACTTAA |

TABLE 1-continued

Weed species and PDS gene sequences

| SEQ ID NO | SPECIES | TYPE | LENGTH | SEQ |
|---|---|---|---|---|
| | | | | CTTCATAAATCCGGATGAACTTTCGATGCAGTGTAT |
| | | | | CTTGATTGCTCTGAATCGATTTCTTCAGGTATAGCC |
| | | | | CCATTTCACTATCTGCTTTAAGTGTGTTTTATTTTCA |
| | | | | ATTGAATTCGACCTATTCAACTATATGGAACTTAAG |
| | | | | TAATTTTGATTTGAACTTATTGATACAAACGTATCA |
| | | | | AAACTTACGATAATCTTTTTCAGTTTGATACACTATC |
| | | | | GTTTTGTTTCTGAGAACTTTTTGTAAATTGGATTATA |
| | | | | TGTGATGTTAAAATTATGGAATTCACTCAACAGGA |
| | | | | AAAGCATGGTTCAAAAATGGCTTTCTTGGATGGAA |
| | | | | ATCCTCCAGAAAGGTTATGCATGCCTATTGTTGAGC |
| | | | | ATATTGAGTCACTAGGTGGTGAAGTGCAGCTTAAC |
| | | | | TCTCGTATTCAAAAGATAAAGTTAACTCAAGATGG |
| | | | | AAGTGTGGATAGCTTCTTGCTAACCAATGGGAAAG |
| | | | | AAGTTAGAGGGGATGCTTACGTCTTTGCTACTCCA |
| | | | | GGTTTACTTTTCTTCTTTACCGAATGGGATTATTATT |
| | | | | CAACTAGGAAATTATTGCCATTTTTAGTCAAGACAG |
| | | | | GCTCCTGAAGAAATTATTTATTGCCATCTGTATTGT |
| | | | | TCTCTGATATACCTTTAAATTTTTATTACAGTTGACA |
| | | | | TCCTAAAGCTACTTCTTCCTGAAGAGTGGAAAGAA |
| | | | | ATTTCATACTTCAAAAAGTTGGAGAAACTAGTAGG |
| | | | | AGTTCCTGTCATTAATGTTCACATATGGTTAGTGAT |
| | | | | ACCTCTTGTCTACAGGAATATAGTTTCTTAATGCTA |
| | | | | TAACCCAATCTTATGTGTCTTCTCTTACTCTATGTAA |
| | | | | TTTTATTTATGTATCTATCTTTCTCTTCCATGTCCATG |
| | | | | TATTTTGTTATTTCTGTCTTTGGCTTTTTAGAATGGT |
| | | | | TTGTCAGTATATCTTTGCAATTAGGCTCTGATTTAAT |
| | | | | AGCCTGCTACTATACGAAGTATATCATTTCTTTGGT |
| | | | | AGTGTATTTTCTGTAGTTTGCGTTGAGAGTTTGAGA |
| | | | | CTCCTATACGTAGAGCTTCATCTTAATAAAATTTTAT |
| | | | | GTCTTGTAAAATCTGTCTGTTTTGAAATGTCAAAAA |
| | | | | AGCTGTCAAAATCTATTTCTCACCCTCTCCTTATGAA |
| | | | | GAACTTCAATGAAATCTCCTCTAATATCGGGACTGA |
| | | | | CATTTAACAACTGTTGGCTTGCAGGTTTGATAGGA |
| | | | | AATTGAAGAATACATATGACCACCTACTCTTCAGCA |
| | | | | GGTGTGTTCAATTAAAGTGCTAAATTCAATATCATT |
| | | | | TTCATAGCACTCAAACAATACTCAAAGATTATCCTT |
| | | | | CCCTTTTTGTCCTTGTTTTATACTCATTTCGTTTTCCC |
| | | | | TTTTTTTGTTGGAAAGCACATTTTGTTGAGCATATG |
| | | | | CCATGAGCTGCATACTTGCATAAAATTGGGCAAAG |
| | | | | GAGCCACAGTCATTTGATATATATGATTTAAGAATC |
| | | | | CTCCTATGAAGTTAGAAAAGTTATGGTACTAGTTTT |
| | | | | CTTTTACTGAGTGAACGGGGTATCCCTGCCAGCAA |
| | | | | TGTGTACAAGGATACTGGCTTGCTGCAGAAAGATA |
| | | | | CTTTCAGTATTGATAAGATACAAATTGCATTTTTCTT |
| | | | | TTGGATGAAATACAGTGAACTGGCAATGGTGTCAG |
| | | | | CTTGAACGTTGAGAATCCTTGATATCCATTTGATTC |
| | | | | ATGTTTTCACTTGTGCGCGGATTTCACTCCTATAAG |
| | | | | TTTGTCATTGCAGGAGTCCTCTTTTGAGTGTCTATG |
| | | | | CTGATATGTCAGAGACATGCAAGGTAATTTCTCCTC |
| | | | | AATTTTGTTCTTCATCATGTAATACATGCTGTCTCAT |
| | | | | TCGCAAACGTCTACTATGTGCTATTCAATCGAAGGC |
| | | | | ATATGTAATGTTATTTAATCAAAAGCATATACTGTA |
| | | | | TATAAGTGCTTTGTCACTTCCAAAACTATGTCTGTTT |
| | | | | TTTAATCCCCTATCGATTTTTTTATTTGTTATTTATTT |
| | | | | CTTAATTGTTTTGTTAGCTTGTTATATGTTTGTCTTT |
| | | | | GAGACTTTTTGGTTGTTATCATTGAACATCTTTATG |
| | | | | ACTTACTCCTTTCGGAATCAAGTTACACATACAATG |
| | | | | AAAGTGTGTATGATTAAATTTGTCAATAGGCTATTA |
| | | | | TTTGTTTGAGTGATGAGGAGATGATAACTTTATTCC |
| | | | | TACTATAAAGAAAAGGTCTACTTTAAAACCTCGTCT |
| | | | | TGTCATTAATTATGAGGGTTGGATGTTGGGATTGA |
| | | | | GATAAATCAACTGATACCAGAACCCAGAAGGGGA |
| | | | | AAATGCAGAAATACTACCTCATGAGCTGTGGCTGA |
| | | | | CCTTTCTGTTCCCATGATCTTGTCTTATTCTATGAGT |
| | | | | ATGAACTAAAGTAGTAGAGTGTTCCCAATCTTTTGG |
| | | | | AGCGTACAGGAATATTATGATCCAAACCGGTCCAT |
| | | | | GCTGGAATTGGTTTTTGCACCTGCAGAAGAATGGG |
| | | | | TTTCTCGGAGTGACACGGACATTATTGAGGCAACA |
| | | | | ATGAACGAACTTGCCAAGCTTTTTCCTGATGAAATC |
| | | | | GCAGCTGATGGGAGCAAGGCTAAGATCCTAAAATA |
| | | | | TCATGTAGTCAAAACTCCCAGGTGAGATAATATGT |
| | | | | ACTATACTGCTCTGTATTAGTTAGATTTGGTAATCG |
| | | | | TTTGTGGTATTAAGCAGACCTTATCTGCTGAAAAGC |
| | | | | AGTATCGATATTTACTACTGTTAAGGTCTCTAACTG |
| | | | | TTAATTCTTCCATTCCTTCACAGGTCTGTTTATAAGA |

TABLE 1-continued

Weed species and PDS gene sequences

| SEQ ID NO | SPECIES | TYPE | LENGTH | SEQ |
|---|---|---|---|---|

```
CAGTTCCAAACTGTGAACCTTGTCGACCATTGCAAA
GGTCACCAATAGAAGGTTTCTATTTATCCGGTGATT
ACACAAAGCAAAAATATTTGGCTTCAATGGAAGGT
GCTGTCCTGTCTGGGAAGTTTTGTGCACAGGCTATT
GTACAGGTAATGAGGTTTTGCTCAAACATCATAAG
CATGATATTCATGAGTTTCACTTCCTATATCTCCTAG
CATACTCATGATATTGTTACTCTATAAATTATGTTTA
CTGAAAATTTAATCCTATTATTCATTTGCAGGATTAT
GATATGCTTGTTGCTCGAGCACAAAGAGAATTGGC
AGGGGCAGGCAACGCCTGATTTGAAATTCTTTGAT
ATTTGCCCATTTTTTTCGTCGGAGATTTGGATTGGT
GATCTTGTTCAGATCGAGTTCAGATCGATATTCAAC
TACTGGAAACAAACTCTGGGAAGCATTCTCAGTTA
TACTCAATTTTTTTTCTGCTGTTCAAGATGTATATGT
GTAGCTTAATTGTAGGGAAACATGTACAGGCATGT
ACTCGTAAGTGGTTTCAAATGTAAGTAGTAATTCAA
TACATGTACTAACATTTCTGTGGAAATAGGAAACT
GTTTTAGAAGAGTGTCCCCTTTATACTTCGTAAATG
ACATTTAGATTGTGGCTTTGTTGCTGGGAGCATGG
TCCGGCTTGGTTAGGAAGCACGAGGCCATTGCCCG
AATGCCGCCAATGTGGATTGATGGATCTTCTCTTAG
CTTCTTAAGGGGTTAGTCTTTTCCATGATACTTCCT
CAGTTATTGAAAGAATGTAAACCTTTTTTTTTTTT
CATTTTGTCGTGAAACTTCGCAATTTTCAATCTTATA
CGTGTATGAAACTTCGATATTACTTCTCCATATTTTT
AATCACAACACGTATGGATTGCCGGATTGGCAATA
AAGTTGATGATAGAGAAAATATGTGGGGGCATAT
GAAATTCTTGTGAGAGTAAAGTGGTGGTCTTGTAT
ACCATTTTAAAAACGTCGTAAACATTTTGAATCAAC
TCAAAAATATAAAAAGTGTCCCCTTTATACTTCATTC
ATTTGCATTTGGACATCCCTTTCAAATATTGCTAAG
CTTAGCTTAGCGATTAGGGTTGAACCTTTTAACCTT
GAGGATGCAGGTTAAATTTTTACTAAAGCATTTCG
GGGTTTTTCTATTATTACTCTTTCCCCCCTACTTTTAA
AGCGTCTAGTCATCAAACTTACAGCGGATCGATGT
TTGAATACGATAACGTTATCCTACAAAAAAGAAGA
AAGGGTACCTCAACCCCAATTCCCCAAGACCTACTC
CCAAAGTCCAAAACAACATGAGTGGATTTGCAAGT
TGCAAATAGGCATTAGGCATATATTATTTGGGCAA
AATAGTAGTAATTGGAGTTGCGTTGTGCATTCTTTG
AAGATTAACTACTTGAGTGTGCGTGCAGTCGGTGC
CGTCAGTAACAAACTACATACACATCACATCTCGAG
GGATGAACCCCCCATTAAGCTACTCTACAAGAACC
ATGAACCTCCATGGGACACCCACACTATGCTACTA
AGCAAAATCCTTAACATCCTCGACTAGATATATACT
TCTTCCGTTTCTTTTTACTGTAAATGCAACAAAAGTA
TCTTTCTGTTTTCACAAATGTCGATTTGGCTTGTAAA
GCTTGTGAATTGGCTCGATTTTTATTTTTCTTTTGCA
GTTTCATAAAATTCGTTACACTTTTCATTCTAAGATG
ATCTCACATTACTTGCTATACTTTTTTTTGTACTAAA
CTATTTATTATATATCTCTTCTCACATGAGTCCTCCT
TGCTTTTTTATTCTCTATCTCTTCCCTCTCCAAAAATC
AGTGAATTGAGAAATGTAGCGAGTAATATGAAATG
GAAGAAGTACTTTGGAAAACATTTGTACTATCAATA
CATACATGAAAACAATGATCCTATCTATTATATATA
TGACAAGATTAAGAAATTTACTGTCTATTAAAACCA
ACAAATTGAATATTAATTGAAGAAGAAAAGGAAAA
CATAAAAACTGAAGGTAACAATGTACTGTATAAAA
CTTGTTCATGAATAGTTTGAAAAAAGGTTCGAACA
ACAATTGGTCAAAACTTAAATTAACAAACTCAAAGT
CGAGATTAAGCTCGAGTAAACTTAAACAAACACTA
ACCGAGCTTATTTTTTAGTTTTTTTAATAAAATCAC
AAAACATTAGAAAAAAAAATCTAGAATACACCAAG
TGTAACAAAGAAATGTTGTCCTTTTACTCGAATAAG
ATTCACAAGCCTTATACAAATCCTTAATTAGCATTA
CATTATTTACATGATACATTGCATTGGGGCACAATT
ATATAACCAAGGATCATGATAACCCACCATTATTTT
TTCAATTAGATAAGTTGATACCATTGCTTAAAATCT
TAACAAAAAATCTATATATCAACCTTAATAAAATTT
AAAATATAAGGTTTACAATATTATTTAATAAAATTG
ATATCAACATTCTTAGCTTTTTGGTGCATGTTGTAA
CTTAGAAAATGGTTTGATTTTATTTTCATGCACCAC
AAATGAGGCTAATCATCTCACTTCAACTCACACATA
CAAGAGCTGTTATGAACTCCTATTCTGAAGCCCAAT
TTACTGAACCTTGAGATTGAGATTAAATTTGTCCTT
```

TABLE 1-continued

Weed species and PDS gene sequences

| SEQ ID NO | SPECIES | TYPE | LENGTH | SEQ |
|---|---|---|---|---|
| | | | | TTATTTGAACCTTAAAGTGTAATTAAAGTTTAAAGT<br>TTTTGTTCTAATAATAATATTCCTTAAACAGATATTT<br>TTTTTTTATATGATTGTTCTCTTTAAGATGCATGTTT<br>AGAAGCAATAATTCTCACATATTTAAGAAAGTGCTA<br>ATTTGAGGTAATTGTGTTGGATGATTGGGTGCGAA<br>TGAGCCGCAATGCTGAATAACGGACTTTTATTAATA<br>TTAACCATTAAACCAAGACTTCATAATAACCCCCTA<br>TGAAATGTCCCTTATACCCTTAATGAATTAAATTAC<br>AATATTTAAAAAAAATTAATAATATATTTTTACTCTT<br>CAATTGTCAATTTGCCATAAATGTTGAATAAGTTTA<br>ATA |
| 69 | Lolium multiflorum | cDNA | 1685 | GCGCTTATCGTTGATTAAACCAGGGCTGACAAGAA<br>TCTACCAGCAGCTGCTTCATTATGGATACAGGCTGC<br>TTATCATCTATGAACATAACTGGAGCTGCGCAAGT<br>GCGGTCCTTTGTGGGACAACTTCATACACAGAGGT<br>GCTTCACAAGCAGCAGTGTCCAGCCGCTGAAAAGT<br>AGTTCTCCAACGAGCGCTGGTTTGGCGTCTCTTGGC<br>TCAAGGAATAGAGGGAAAAAATCACGCCGTGGGC<br>TTGCTGCTCTGCAGGTTGTTTCCCAGGATTTACCAA<br>GACCTCCACTGGAAAACACAATTAACTATCTGGAA<br>GCTGGGCAGCTTTCTTCATCTTTTAGAAGCAGTGAA<br>CGACCCAGTAAACCATTACAGGTCGTGATTGCTGG<br>TGCAGGATTGGCTGGACTATCAACTGCAAAATATC<br>TAGCAGATGCTGGCCATAAACCCATATTGCTAGAG<br>GCAAGAGATGTTTTGGGTGGAAAGTTAGCTGCTTG<br>GAAGGATGAAGATGGTGATTGGTATGAGACTGGT<br>CTTCATATTTTCTTTGGAGCTTATCCCAACGTACAG<br>AATTTGTTTGGTGAGCTTGGTATTAATGATCGCTTG<br>CAATGGAAGGAACACTCTATGATATTTGCCATGCC<br>AAACAAGCCAGGAGAATACAGCCGTTTTGATTTCC<br>CAGAGGTTTTGCCAGCGCCTTTAAACGGAATATGG<br>GCCATACTGAAGAACAATGAAATGCTTACTTGGCC<br>GGAGAAGGTGAAGTTTGCTATTGGACTTCTTCCAG<br>CAATGCTTGGTGGCCAAGCTTATGTTGAAGCTCAA<br>GATGGCTTAACTGTTTCAGAGTGGATGGAAAAGCA<br>GGGTGTTCCTGATCGAGTCAACGATGAGGTTTTTA<br>TTGCAATGTCCAAGGCACTCAATTTCATAAACCCTG<br>ATGAGTTATCCATGCAGTGCATTCTTATTGCTCTAA<br>ACCGATTTCTCCAGGAGAAGCATGGCTCAAAAATG<br>GCATTCTTGGATGGTAATCCACCTGAAAGGCTATG<br>TATGCCTATTGTCAACCACATTCAGTCTTTGGGTGG<br>TGAGGTCCGCCTGAACTCTCGTATTAAGAAAATTG<br>AACTGAACCCTGACGGGACTGTGAAGCACTTTGCA<br>TTGAGTGATGGGACTCAAATAACTGGAGATGCTTA<br>TGTTTGTGCTGCACCAGTTGATATCTTCAAGCTTCTT<br>GTACCGGAACAGTGGAGAGAGATCTCTTATTTCAA<br>GAGGCTGGATAAGTTGGTGGGAGTTCCTGTCATCA<br>ATGTTCATATATGGTTTGACAGAAAACTGAAAAAC<br>ACATACGACCACCTTCTTTTCAGCAGGAGTCCACTT<br>TTAAGCGTCTATGCAGACATGTCAGTAGCGTGCAA<br>GGAGTATTATGATCCAGACCGTTCAATGCTGGAGT<br>TGGTGTTTGCTCCAGCAGAGGAATGGATTGGACGT<br>AGCGACGCTGAAATCATCGAAGCAACCATGCAAGA<br>GCTAGCCAAGTTATTTCCTGATGAAATTGCTGCTGA<br>TCAGAGTAAAGCAAAAATTCGTAAATACCATGTTG<br>TGAAGACACCGAGATCTGTTTACAAGACCATCCCA<br>GATTGTGAACCTTGCCGACCTCTGCAACGATCACC<br>GATCGAAGGGTTCTATCTGGCTGGCGATTACACGA<br>AGCAGAAATATTTGGCTTCCATGGAGGGT |
| 70 | Lolium multiflorum | Genomic | 1670 | AAGGAAACAGTGCACCAGCGTCGTCGTCGCCCGAC<br>CAAAGGTCTTAGATTTTCACCCTGAAGATAGTCCCC<br>ACTCTCAAAACAATGCCTCCAACAAGAACATTGCCA<br>GGCACAACCAGTTAAGGCCNNNCCTTGGGTTTTCA<br>CCCTGAGAGGTAAGACTCTGAGCTTCCCCTGTGCT<br>GCCGCCCCNNATGCATACCACTGCTGCAGAGCCT<br>GGAACGCCGAGCAGATCCCTCAGCATCACGGAGAC<br>TCAAACCTCCTTTAGCCAGTCCACCAATCTGGCCTT<br>CATGATATTCCTTCTTCTGACTTCACCATGGACCAA<br>AAAGTCACCTGATGTACACACAGAATAGAGCTTCG<br>CGCCGCTCCTTCCGGAACCAAACGGTCGGAATAAA<br>AACATGGGTGCGCGCGACCGAATACCACCTGATCC<br>AGCAAACTGCAGGCAAAAGATGCACTGTTCCATTC<br>ACCAGCGGAGCTTTCGGAACTCATCTCTCCAGCTA |

TABLE 1-continued

Weed species and PDS gene sequences

| SEQ ID NO | SPECIES | TYPE | LENGTH | SEQ |
|---|---|---|---|---|
| | | | | GATCAAAGCAAACTGATCTCCGGAAGATCTTCATCC TCGCATGCGAGAAACCCGAGGACCGCCACCAAAAA CAAAGAAAGATCAGCAGCCCCCACGCCGCCAATCC CTCTTGCCGGATCACCAAAGAAGAGGACAGCGACG CAGATCATGCGTACGGCCGCCAAACCGTTACCGGG GGCGGAGGCCGCCACCGCTCCACCGAATCCTCCAT GGCTACCGACGGAGAGCCTCAGGCCCCAGCCAAGT AGCCGTGCCGCCCGGCTTCCTCCACTGGCGCTACAT CACCTCCCATGGAACGCCGCCGCGGAAACCCTCTT CTCCCCCTCGTCGATTCGACGAAAGGGGTGCCGCC ACCACCGCTAGAGCCAGGCCGGGACCGGGGCCGA GGCACGGGGCCGGGGCCGAGGCCAGCGCCGGG GTCGGGGCCGCGGCCGGAAGCGGCAGCGGCTGA GGGCGACGGGCGGCGGGTGGATGTAGGCCGCGG GGGGAGGAGGAGCCTCCGCCGCCGCCCGGGAGG GGGGCGGGAGAGGGGGGCGGCGGGTTAGGGTTA GGTGAGTAGCCCCAGATGAGTCAAACTTCTATTGT TGTGTTGGTGCGTTATGGTATGGCATTATTGTGGTC TAATCACCTCTCTGCTTGCAGGATTCTAAATTGTTG TCCCGTAGGAGCCAGGAAAGCCTGAAGACAAAATC CGAAGTTCCCGTCGCTTCCTAGGTGTATTTAATTAG CACACAAATCATTCTTAGCACATTCTGTGGTATTTTC ACACTGTTGTAGAGTTGAACAGGTGATTGAGCTGA TATCCATATTGTGAAAAAGGAAATCTGTAAACGA GAAGCTGCATAAAAGCAGCTCTGATCCATATAGCA ATTCTTACGTTAGACCTTTCCGGAAGGCAAAAGTG ATAAAAAAAGGATCTTAGATATTATCTTCGTTTGCA ACAATTGGAACTGGATCATTAACCGCTTACTTTTCT GGAATTGTATAACATTAAAACCTAAGGTTCGTGTC AGCAAAAGGGGATGAAATCATGGATAATATCCTAG CATCTAAATCTTGTAAGCAAATGGGATTATGATAT TTGGCAGTTGCAACACCAAGCTGCAGTTACAAAAA GGAGGCACAGAGACAGGCCCTGAGATAGATGATG GGGCCTCAGTAAGTGAGATATT |
| 71 | Lolium multiflorum | Genomic | 1612 | CAAAAGTTCAGAACAAAAAAATAGAGAGAAACAC CAAAGTTGTTTCTCTGAAACCGTCATGCCATTCTTT AAAAGGAAGAAGAGGTATTTTCAAAACATCGTGCT TCACTGCTTCTGCTGATTATGTGCATATACAAAGTT ATAAGTTCATTGGAAACGATACTAGTTAGCCTTTAG ACATGCATTTGGATCCCTGCTTTGTTTCATGTTGTTA GCAAATTCCTACACCCTTGAAATAAAAAGATTATTA TCTTGCTGTTCTTTTAAAGGGTAACTTGATTGTGAA CGTGATGCCGGCGGGCTGGACAGATGGGAGGCAC AGACTTTATATAAGCTCCATGGAAGCCTCTTTCATC GATCAACTCTACGGCTACAAAGTAAATCAGAAAGC CCATGACTTGAAAATCATCCGCGGTGGAGTGTTGG GGAAACTCAAATCGCAGAGGACCAATGTTCGTGCT CCAGTAACGGGTGAATGCCTCCTGCCTGCAAACCC GTGGATGCGTGACTGCAGCAGCAGCAGCAGCAAT GCAAGAAGTGATGTAGCAAAAACCGCAGTGGGTG ATCACGAGTCTGGTATATGGACTATCCATGGGAGG AGTCCGCTGTCGCATGAAAGGGAATTGGGAGCTTG CAATGGAGAAAAACTTCTCCATGATAATACAGGTA GCTATCTCAGTTACCTCATTCAACTTCCGGTGTATC ATATGTTTTCAACACTAGCTGATTTTATGGAAGATG CATGAACAATTCAAAAATCAATTGTGTGTAAGCTCC AAGATGCTGTCTGTCTGAACGTACCTATGTTAGCAA TAAGCTCGTAAAAGTTAGACTGCTAACCATGCTCTG AAGCAGTCTGCTACGAAGAACTAAATATCTGATGC CATTTTTTTCTCTCCCTGCAGAGGTCTCTGATGAG AACTTTTCTGACTACGAGACGAAACTCGATGCGGA ATCAAGTAAATTGTGCAAGAAAAGGAGGTTAAGCA GTACTTCCACTTACTGAATGATCAAATGAGCTCGCA TGATTAATTAGCATATAGTGTGTTGCAAGCATTGA GATGAAAAGCAACACACCGAATTACTCAAAGAACC TGTTTGCTGCCTCAAAATCTGTTCGGAGCCTGTTTG TATCCTGTCAGACGCCCTCACTCACTACTTGGAGTA GTAGATAATATTGTTTCGTTTATTGGATGCAAATGC AATGCATTCTATAAAGTTTGACTAATTATATGGAAA AAAATTAACAACTAAAATATCATATCACTGTTATTA GAACCACCATGGAATATATTTTCATAGTATATGCAT TTGGTATTGCGATGTATGCTGAAATAGAGTGGGTA TTATCTCTAGGAGGCTTCTTCCTTTCAAGTCAAGTTT TGTATCCCGATATATACTCACCCGAGACCGAGAGA |

TABLE 1-continued

Weed species and PDS gene sequences

| SEQ ID NO | SPECIES | TYPE | LENGTH | SEQ |
|---|---|---|---|---|
| | | | | CACCGATACAACAATGTCCAAAGAGTAACGTCAAT<br>TTCATACTCTTTCAGGAACCATGCATCTAAGGCAAA<br>CGTTGTAATTAATCAATAAGGTACAATATGAGACC<br>AGAGTGTGGTGCTTGGCCGGGGCCAAATATTTTAG<br>TAATGTAATCCCAAGAGAGTAGTATGTCGTGTAAT<br>GCCTAGGATTTGTCTGA |
| 72 | Lolium multiflorum | Genomic | 1352 | AACTGAACCCTGACGGGACCGTGAAGCACTTTGCA<br>TTGAGTGATGGGACTCAAATAACTGGAGATGCTTA<br>TGTTTGTGCTGCACCAGGTGTGATTTATTTTCAAGA<br>ATCATGTTTTCTTTACACCTGTTCAGTTTAACTGACT<br>AGCCTGTTATTCAGTTGATATCTTCAAGCTTCTTGTA<br>CCGGAGCAGTGGAGAGAGATCTCTTATTTCAAGAG<br>GCTGGATAAGTTGGTGGGAGTTCCTGTCATCAATG<br>TTCATATATGGTGAGTTGATTGAAACTATTGGTTCT<br>AAGTCAAGACAACTTCGTGTTTTTCGGTTCGACTTA<br>TGGTCCTGCCTCATGTGTTATTTCAGGTTTGACA<br>GAAAACTGAAAAACACATACGACCACCTTCTTTTCA<br>GCAGGTATTCCTTTCTTCATACTCATCTTCCTGTTGG<br>CACCTAGTGCATTTTGTTGTCTTGTATTCAAATTGA<br>GCGTCTTCAATCCTACCCCTACATGCTTTGAATGTG<br>TTTTTGTTTGATACCAAGTACCAGATGTCCCTTATGT<br>TGATCTTGTTCACTTCTGTTTCAGGAGTCCACTTTTA<br>AGCGTCTATGCAGACATGTCAGTAGCTTGCAAGGT<br>ACTAACTCAAGGAGTTATTAATATTGCATAGATACT<br>AATATGAGGCATGTGATCCTGCATTCTTCTTGGAAT<br>CCACCATATTAAGTATTGATTGCGGGTTAACCGGA<br>ATTGTACTTTGAGGACTATTGACCAAAGGCCCAAA<br>ATGCTTTTGCTAAGAAGGAATCATTATTGAACTTAA<br>AATTATAGATACCTTTGGCATTGCAAATTGTAGTTA<br>TAAATTACTGAAGTATAGCATTTTTGTCATTGCTAA<br>CATGTCCGTTGGCTGTTGATTTCGTGAATCATTTTA<br>GTTAGAATAACTGAATAACCGTGCTAGCTTAACTG<br>AAAGAACGAAGGACATGGATGCATACTCGTAATTT<br>TATTTTTTCCTTGTTCTTTAACTCTATGCAGGAGTAC<br>TATGATCCAGACCGTTCAATGCTGGAGTTGGTCTTT<br>GCTCCAGCAGAGGAATGGATTGGACGTAGCGACG<br>CTGAAATCATCGAAGCAACCATGCAAGAGCTAGCC<br>AAGTTATTTCCTGATGAAATTGCTGCTGATCAGAGT<br>AAAGCAAAAATTCGTAAATACCATGTTGTCAAGAC<br>GCCGAGGTGAGGACATTTTGCTAACACCCATCCTG<br>TTGATTAATCAAAAGGACACCTGATGTGGTCTTGTT<br>CTCTTACACTGTTTATATTTTTCTGGCTCGCTGTTAC<br>AGATCTGTTTACAAGACCATCCCAGATTGTGAGCCT<br>TGCCGACCTCTGCAACGATCACCGATC |
| 73 | Lolium multiflorum | Genomic | 1210 | CCTTTGTACTCTGTGTATAGGTTATATCCATTGGCA<br>GTGTACAGATAGTATTTGATGCCTCAGACAAATAT<br>GTACACAATAATAAGATAGAACACCTTGAGTGAAG<br>TACAAAGTGATTTTTGAGTAGTCACATTGAGGTTCT<br>GAAATTGCAAATAAGAGAAGAGTTTCATACTGTCA<br>AATTTTTAGCTTGTTTGCATTTTATTAATGGGCCTTA<br>TTCTCTTAATAATATTTTTACCGGGTTTTTTGCGTGA<br>CTGTATGAAAATATATAAGGGATTCACGCATACAG<br>TAGCTTAGATTTAATGTTCCATACATCATTGTTGG<br>CCTGGTTGAATTTTTTTTGTCTATAAATTCTCTTCT<br>ACCAGCCTTTTCTCCCTGCCGGTAGCTTGTGTACGG<br>TACTTCTCATTCTGTGCATGTATGTAACCATATGTTT<br>TTTTTTTGGGTTTTAAGTTGGAGCTTATCCCAACGT<br>ACAGAATTTGTTTGGTGAGCTTGGTATTAATGATCG<br>CTTGCAATGGAAGGAACACTCTATGATATTTGCCAT<br>GCCAAACAAGCCAGGAGAATACAGCCGTTTTGATT<br>TCCCAGAGGTTTTGCCAGCGCCTTTAAACGGTAAG<br>ATCATACATAGCCCTGGTGTTGCTTAATAGATGAAA<br>GAATGGCAAGAAAACTTAGGAATGCATCCTAGTGT<br>TAGTTCTTTCATTTTGCTAATATTTGAATGCAACTAG<br>TGGGGTATGTTAGTGCAAACAACATTGTCATGGCC<br>ATCCAGCTGTTCTCTTCCCATCAATGTCAGTTTATCA<br>TTGATTATGCATGTATTTAACAGGAATATGGGCCAT<br>ACTGAAGAACAATGAAATGCTTACTTGGCCGGAGA<br>AGGTGAAGTTTGCTATTGGACTTCTTCCAGCAATGC<br>TTGGTGGCCAAGCTTATGTTGAAGCTCAAGATGGC<br>TTAACTGTTTCAGAGTGGATGGAAAAGCAGGTATG<br>AGCCCACCAAGTCAGTTAGACTCATCTCTTTGTACT<br>GAACACATAGCCGTCTCAATTCACACTTGATATATG |

TABLE 1-continued

Weed species and PDS gene sequences

| SEQ ID NO | SPECIES | TYPE | LENGTH | SEQ |
|---|---|---|---|---|
| | | | | AGGATATGTTGTAACGCGATAAATTGCTGCCTTCCT TCTATTGTTATATTTTTATGAAGAAGTGTGGCTAGG TCCATAAATGAAACTATATGCTCAAGTTTCCATACT TTTTTCCACCCAGCCCTTTTGTATGCAATGTAGGCTT AAGTAATACTTATATTTCTATTAATC |
| 74 | Lolium multiflorum | Genomic | 1057 | TCTTGGCTCAAGGAATAGAGGGAAAAAATCACGCC GTGGGCTTGCTGCTCTGCAGGTTAAGATTTCGTCCC TGTTCGGAAAATAAAGTGGTTTCTCTATTTTATCTC ACCACAGCCGTTTCTTGTGAAGTAATTGTTTGCATT TTCTGCAGGTTGTTTCCCAGGATTTACCAAGACCTC CACTGGAAAACACAATTAACTATCTGGAAGCTGGG CAGCTTTCTTCATCTTTTAGAAGCAGTGAACGACCC AGTAAACCATTACAGGTCGTGATTGCTGGTGCAGG TCTGATGTAACTCCTGGATTAGAACATATATGAATT TCACAAATTAGATACCCCCCCTGAGTGAAGCACAA CTGCCTCTTAGCGTTACTCGTCTCTGGTGTGAATTG TGCAGGATTGGCTGGACTATCAACCGCAAAATATC TAGCAGATGCTGGCCATAAACCCATATTGCTAGAA GCAAGAGATGTTTTGGGCGGAAAGGTCTGATAGTT TCTTACATCTGTTGCTTATCTCATCTCTAAAATTGTG CTGGTTATTTAATCTGACTTTTCAGTTGCTGTCGTCA TTCTGAGTAGCTCACCTTCACCATTATTGTTGCTTGA TTGCTTCTATCCTTGTATGCCTTCAACAGTTAGCTGC TTGGAAGGATGAAGATGGTGATTGGTATGAAACT GGTCTTCATATTTTCTGTAAGTTACGGTACTTCCTTG TTCCTTTGTGCCCTGTGTATAGCTTGTTTCCACTGGC AGTGTATAGATAGTATTTGATGCGTCAGACAAATA TCTACATAATAATAAGATAGAATACCTTGAGTAAA GTACAAAATGATCTTTGAGGAGCCACATTGAGGTT CTGAAATTGCAAATAAGTGAAGAGTTTCATACCGT CAAATTTTTAGGTTGCTTGCATTTTATTAATGGGCC TTATTCTCTTAATAATATTTTTAGTGGGTTTTTTTTT GTGTGACCGTATGAAAACATATAGCTTAAATTTCAA TGCTGTGCATGTATGTAACCATATTTTTTTTGGGTT TTAAGTTGGAGCTTATC |
| 75 | Lolium multiflorum | Genomic | 999 | ATTACAGATACCTTTGGCATTGCAAATTGTAGTTAT CAATTACTGAAGTATAGCATTTTTGTCATTGCTAAC ATGTCAGTCGGCTGTTGATTTCGTGAATCATTTTAG TTTGAATAACTGAATAACCGTGCTAGCTTAACTGAG AGAACGAAGGACATGGATGCATACTCGTAATTTTG ATTTTCCCTTGTTCTTTAACTCTATGCAGGAGTATTA TGATCCAGACCGTTCAATGCTGGAGTTGGTGTTTG CTCCAGCAGAGGAATGGATTGGACGTAGCGACGC TGAAATCATCGAAGCAACCATGCAAGAGCTAGCCA AGTTATTCCTGATGAAATTGCTGCTGATCAGAGTA AAGCAAAAATTCGTAAATACCATGTTGTGAAGACG CCGAGGTGAGGACATTTTGCCAACACCCATCCTGTT GATTAATCAAAAGGACACCTGATGTGGTCTTGTTCT CTTACACTGTTTATATTTTTCTGGCTCGCTGTTACAG ATCTGTTTACAAGACCATCCCAGATTGTGAGCCTTG CCGACCTCTGCAACGATCACCGATCGAAGGGTTCT ATCTGGCTGGTGATTACACGAAGCAGAAATATTTG GCTTCCATGGAGGGTGCAGTTTTATCCGGGAAGCT CTGTGCCCAGTCCATAGTTCAGGTAAATGCTTTCCA CGGTTCTGGTTGCACATAGATGAGTCAAACTTCTAT TGTTGTGTTGGTGCGTTATGATATGGCATTATTGTG GTCTAATCACCTCTCTACTTGCAGGATTCTAAATTG TTGTCCCGTAGGAGCCAGGAAAGCCTGAAGACAAA ATCCGAAGTTCCCGTCGCTTCCTAGGTGTATTTAGT TAGCACACAATTCATTCTTAGCACATTCTGTGGTAT TTTCACACTGTTGTAGAGTTGAACAGGTGATTGAG CTGATATCCATATTGTGAAAAAGGAAATCTGTAAA ACGAGAAGCTGCATAAAAGCAGCTCTGATCCATAT AG |
| 76 | Lolium multiflorum | Genomic | 677 | TTCAACAGTTAGCTGCTTGGAAGGATGAAGATGGT GATTGGTATGAAACTGGTCTTCATATTTTCTGTAAG TTACGGTACTTCCTTGTTCCTTTGTGCCCTGTGTATA GCGTGTTTCCACTGGCAGTGTATAGATAGTATTTGA TGCGTCAGACAAATATCTACATAATAATAAGATAG AACACCTTGAGTAAAGTACAAAATGATCTTTGAGG AGCCACATTTAGGTTCTGAAATTGCAAATTAGTGA AGAGTTTCATACCGTCAATTTTTTAGGTTGCTTGCA |

TABLE 1-continued

Weed species and PDS gene sequences

| SEQ ID NO | SPECIES | TYPE | LENGTH | SEQ |
|---|---|---|---|---|
| | | | | TTTTATTAATGGGCCTTATTCTCTTAATAATATTTTT<br>AGTGGGTTTTTTTTGCGTGACCGTATGAAAACATA<br>TAGCTTAAATTTCAATGTTCCATACATCGTTGTTGG<br>CATGGTGGAATATTTCTTTTGTCTATAAATTCTCTTC<br>TACCAGCATTTCCTCCCTGCCAGTAGCTTGTGTACG<br>GTATTCATTCTGTGCATGTATGTAACCATATGTTTTT<br>TTTTTGGGGGGTTTAAGTTGGAGCTTATCCCAAC<br>GTACAGAATTTGTTTGGTGAGCTTGGTATTAATGAT<br>CGCTTGCAATGGAAGGAACACTCTATGATATTTGC<br>CATGCCAAACAAGCCAGGAGAATACAGCCGTTTTG<br>ATTTCCCAGAGGTTTTGCCAGCGCCTTTAAAC |
| 77 | Lolium multiflorum | Genomic | 653 | AGTACCTCTCCGAGCTCCACATATTAGCCTTGGGTG<br>TTTCTGCCTCCTTTGGTCGATCCTTCTCTGTGTCTGA<br>TGATCACCGGGGAGATGAGCGAAACGTCTGTGGA<br>TGGACCGCTTAAGGCACAGCCACCGGCCATCCGCA<br>TTCCTCAGGTAACAACAACTCCTCTTGCAGGCACGT<br>GGTCCTTGTTTATTTTCATTTTTGTTCTTGCTGCTCA<br>TTACTTTCATGCTTTGCTTCCTAATGATATGCTTGCT<br>CCATTTACTAACAGTTACACATTCGGCAGATTCATG<br>GTCAATCTCTTGTTGCGGACATAAAACTCCTTTTATT<br>TTTTCCAAGTCCGAAATTATTTGCATACATAGATGT<br>TGCTATCATATTCTTGTTCCCTTGAGGCCTTGACGA<br>CATAATAAACCGATTACTATCTTGTTCTTTGGCAGG<br>GCACGTTAACCCTTTTCTTTTCAAGTCCAAAACAAA<br>TAAATCTTGTTCGTAACAGAAAAAACAAAGGAGCA<br>CCCAAGTGTGCTGTTTCTCTGAAATATATACCCTCA<br>TGCCATTGCTCAAAAAGAGGTATCTTCAGAATATG<br>CTGCTCCTGCTCCTTATGTGCATATAAATAACTATA<br>GGCTTATGCTTCCATACACCCCCAAATCTCAAAACC<br>GATTGC |
| 78 | Lolium multiflorum | Genomic | 189 | ATCGAAGGGTTCTATCTGGCTGGTGATTACACGAA<br>GCAGAAATATTTGGCTTCCATGGAGGGTGCAGTTT<br>TATCCGGGAAGCTCTGTGCCCAGTCCATAGTCCAG<br>GTAAATGCTCTCCACGGTTCTGGTTGCACATAGATG<br>AGTCAAACTTCTTTTTTTAGATAAAGGGAATATATT<br>AATATCAAAAGA |

SEQUENCE LISTING (2176 sequences)

SEQ ID NO: 1 - DNA, 1915 bp, Abutilon theophrasti
ttgaagaaaatgagtctctgtgggagtgtttctgctgtgcacttaaacttccaaagcaacacgataagcatgggaagtgttttagcttttagaagcggtgaatccatgggaaattccttgagaattcccttaaaaaagaggtcaagtaagggtgcacgtcctttgcaggtagtttgcatagattatccaaggccagagcttgagagtactgctaactttttggaggctgcttctctatctgcttcttttcgttctgctccccgtccaactaagccattgaaagtcataattgctggtgcaggtttgggtggtttgtcaactgctaagtatctggcggatgcaggtcataaaccaatattattagaagcgagagatgttctaggtggaaaggtggctgcatggaaagatgatgatggagattggtatgagacaggcttacatatattctttggggcttacccaaatgtgcaaaacttgtttggtgaacttggcatcaatgatcggctgcaatggaaggagcattctatgatatttgcgatgccaaataaacctggagagttcagtcgatttgattttccagaagttctacctgcacccttaaatgggatatgggccattttgaagaacaatgaaatgctgacttggccagagaaagtgaaatttgcaataggactgctacccgcaattgttggtggacaagcttatgttgaggcccaagatggtttatctgttaaagagtggatgagaaagcagggggtacctgatcgtgtgaccgaggaggtgtttattgccatgtcaaaggctctaaacttcattaacccagatgaactttcaatgcaatgtatattgattgctttgaatcgatttcttcaggagaaacatggatcaaagatggcattcttggatggcaaccctccagagaggctttgcatgccaatcgttaatcatattgagtcattaggtggtgaggtccggcttaactcacgaataaagaaaatagagctcaatgatgatggaactgtgagtagttttcttttaactaatggcagtacaattgaaggagatgcttatgtagttgcaactccagttgatatcttcaagttacttttgcctgaagactggagagcgatttcttacttcaagaagttagagaaattagtaggagttccagttatcaatgttcacatctggttcgataggaaattgaagaacaccgctgataatcttctcttcagcagaagttctcttctaagtgtttatgccgacatgtctgtaacgtgtaaggaatactacaatccaaaccaatccatgttggagttggtttttgctccggcagaagaatgggttgcacgtagtgactcagaaattattgatgctacaatgaaggaacttgcaaagctctttcctgatgaaatatctgcagatcagagtaaagcaaaaatcgtgaagtaccatgtcgttaaaacaccaagatctgtatataaaactgttccgaattgtgaaccctgccgccccttgcaaagatctccgatacaaggattctatctagcaggtgattacacaaagcaaaagtatttagcttcaatggaaggtgctgtcctctcagggaagctttgtgcacagtctattgtacaggattacgagttgcttagctactttgggacaaagaaggttgacagtggcaagcatcaactgatgtcgtttaaatcgaggtaaacagttcacaagttaccgaggatcatctgctaatccattgtttaaggccacttagattagaggtcttttttcattacatatgtatactgaataccccatataaaaacctgaaacttgtgcaaagatagcatcacaaactgtgtgtaaaattcttttgatggaatctacatgatcttcaatatcccgttaaaagaaaaaa

SEQ ID NO: 2 - DNA, 414 bp, Amaranthus chlorostachys
gattcagttggaccagagtggaagcgtgaagagttttttgctaaataacgggagggaaatacgaggagatgcctatgtttttgccaccccagttgacatcttgaagctgttactacccgatacttggaaggaaatctcatacttcaaaaagcttgagaaattagtgggcgttcctgtgattaatgttcacatatggtttgacagaaaattaaagaatacatatgaccatctactcttcagcaggagtcctcttttgagtgtctacgctgatatgtcggagacatgcaaggaatataaggatcctaatagatccatgctggagctggtttttgcacccgcggaggaatggatttcacgaagcgacactgatattatcgaggcaacaatgaaagagcttgccaagcttttcccggg

SEQ ID NO: 3 - DNA, 2020 bp, Amaranthus graecizans
gaacaaactttgtgggggggtggtgaaaaatgagtcattttggatatgcttgtgctactcaatccacatcaagatatgttcttttaggaaattcaaataaccccacttcagtttcatctattggaagtgattttttgggtcattctgtgagaaatttcagtgttagtaaagtttatggtggaaagcaaagaaatgggcactgccctttaaaggttgtttgtatagattatcctaggccagagcttgaaagtacatccaatttcttggaagccgcctacttatcttctacttttcggaattcgcctcgtcctcagaagccattagaagttgtaattgccggagcaggtttggctggtctatccacggcaaagtatttagctgatgcaggtcacaaacccatattgctggaagcacgagatgttttaggaggaaaggttgcagcatggaaggatgaggatggtgactggtatgagactgggctacatatattctttggggcatatccaaatatccaaaatctatttggagaacttggtataaatgaccgattgcaatggaaggagcactctatgatttttgcaatgcctagcaaacccggtgaattcagtcgctttgattttctcgaagtcctgcctgcaccattgaatggcatatgggcaatcctaaggaataatgaaatgctaacctggccagaaaaaatcaagtttgccattggcttgttgcctgctatggctggcggacagtcatatgttgaggcacaagatggtttgagtgtccaagagtggatgagaaagcaaggagtacccgatcgtgtaactgatgaagtatttattgccatgtcaaaggcactgaacttcataaatcccgatgaactttcgatgcagtgcatcttgatagctcttaaccgattcctacaggagaaacatggttctaagatggcctttctagacggaaaccctccagagaggctttgcatgcctattgttaagcacattgagtcactaggtggtgaagttcaacttaactctcgtatacaaaagattgagttggatcagagtggaagcgtgaagagttttttgctaaataacgggagggaaatacgaggagatgcctatgtttttgccaccccagttgacatcttgaagctgttactacctgatacttggaaggaaatctcatacttcaaaaagcttgagaaattagtgggcgttcctgtgattaatgttcacatatggtttgacagaaaattaaagaatacgtatgaccatctactcttcagcaggagtcctcttttgagtgtctatgctgatatgtcagagacatgcaaggagtataaggatccaaatagatccatgctggaacttgtttttgcacccgcggaggaatggatttcacgaagcgacactgatattatcgaggcaacaatgaatgagcttgccaagcttttcccggatgaaatcgctgctgacgggagcaaggccaagatccttaaatatcatgtcgtcaaaactccaaggtcggtttataagacagtaccggattgtgagccttgtcggccgctgcaaagatcaccaatagagggattctatttagctggtgattacacaaaacaaaaatatttggcttctatggaaggtgctgtcttatctgggaagctttgtgcacaggctattgtacaggattatgatctgctgagttctcgagcacaaagagaattggcggcgagaagcaatgtataaccctggattgcttcgacatccgccattgattttcattcgagatcaggattgggaatctgatcagtcatcgaataatgatcggctgtaaacaaaattatgggggttgcataccggtgctcgtcaagttgacgtataaattctccagaatgaagatttatttgtaatgatatctattaaatattttaatttattttctgatagaaatatgtatagctcacttctagggaataaacatgtatgtggaccagttaacttgattgaaatgtaagtatcaactttgt

SEQ ID NO: 4 - DNA, 1938 bp, Amaranthus hybridus
ctaaattccaacaatttggtccatttttcttgttctttcagtttcacataccctcttatcaatctatatccaaaactatttcattttccaaactcttttaaacccaaaaatcaaaacttttgattgaagaacaaactttggggttttggaaaatgagtcattttggatatgcttgtgctactcaatccacatcaagatatgttcttttaggaaattcaaataaccacacttcaatttcatctattggaagtgattttttgggtcattctgtgagaaatttcagttttagtaaagtttatgggggaaagcaaagaaatgggcactgccctttaaaggttgtttgtatggattatcctaggcctgagcttgaaagtacatccaatttcttggaagctgcctacttatcttctacttttcggaattcgcctcgtcctcagaagccattagaagttgtaattgctggagcaggtttggctggtctatccacggcaaagtatttagctgatgcaggtcacaaacccatattgctggaagcacgagatgttttaggaggaaaggttgcagcgtggaaggatgaggatggtgactggtacgagactgggctacatatattctttggggcttatccaaatatccaaaatctatttggagaacttggtataaatgatcgattgcaatggaaggagcactctatgatttttgcaatgcctagcaagcctggtgaattcagtcgctttgattttcccgaagtcctgcctgcaccattaaatggcatatgggcaatcctaaggaataatgaaatgctaacctggccagaaaaaatcaagtttgccattggcttgttgcctgctatggctggcggacagtcatatgttgaagcacaagacggtttgagtgtccaagagtggatgagaaaacaaggagtacccgatcgtgtaactgatgaagtatttattgccatgtcaaaggcactgaacttcataaatcccgatgaactttcaatgcagtgcatcttgattgctctgaaccgattcctgcaggagaaacatggttctaagatggccttcctagacggaaaccctccagagaggctgtgcatgcctattgttaagcacattgagtcactaggtggtgaagttaaacttaactctcgtatacaaaagattcagttggatcagagtggaagcgtgaagagttttttgctaaataacgggagggaaatacgaggagatgcctatgtttttgccaccccagttgacatcttgaagctgttactacccgatacttggaaggaaatctcatacttcaaaaagcttgaaaaattagtgggcgttcctgtgattaatgttcacatatggtttgacagaaaattaaagaatacatatgaccatttactcttcagcagaagtcctcttttgagtgtctatgctgatatgtcggagacatgcaaggaatataaggatcctaatagatccatgctggaactggtttttgcacccgcggaggaatggatttcacgtagcgacactgatattatagaggcaacaatgaaagagcttgccaagcttttccccgatgaaattgctgccgatgggagcaaggccaagatcctcaaatatcatgtcgtcaaaactccaaggtcggtttataagactgtaccggattgtgaaccttgtcggccgctgcaaagatcaccaatagagggtttctatttagctggtgattacacaaaacaaaaatatttggcttctatggaaggtgctgtcttatctgggaagctttgtgctcaggctattgtacaggattatgatctgctgagttctcgagcacaaagagaattggcggcgacaagcaatgtataaacctggattgctttgacatccgccattgattttcattcgagatctggattgggaatctgatcagtcatcgaaaaat

SEQ ID NO: 5 - DNA, 1947 bp, Amaranthus lividus
gggttttggaaaatgagtcattttggatatgcttgtgctactcaatccacatcaagatatgttcttttgggaaattcaaataaccccacttcaatttcatctattggaagtgattttttgggtcattctgtgagaaatttcagtgttagtaaagtttatggggcaaagcaaagaaatgggcactgccctttaaaggttgtttgtatagattatcctaggcctgagcttgaaagtacatccaatttcttggaagccgcctacttatcttctacttttcggaattcgcctcgtcctcagaagccattagaagttgtaattgccggagcaggtttggctggtctatccacagcaaagtatttagctgatgcaggtcacaaacccatattgttggaagcacgagatgttttaggaggaaaggttgcagcgtggaaggatgaggatggtgactggtatgagactgggctacatatattctttggggcatatccaaatatccaaaatctatttggagaacttggtataaatgaccgactgcaatggaaggagcactctatgatttttgcaatgcctagcaagcccggtgaattcagtcgctttgattttccagaaatcctgcctgcaccattaaatggcatatgggcaatcctaaggaataatgaaatgctaacctggccagaaaaaatcaagtttgccattggcttgttgcctgctatggcgggcggacagtcatatgttgaagcacaagatggtttgagtgttcaagagtggatgagaaaacaaggagtacctgatcgtgtaactgatgaagtgtttattgccatgtcaaaggcactgaacttcataaatcccgatgaactttcaatgcagtgcatcttgattgctctgaaccgattcctgcaggagaaacatggttctaagatggccttcctagacggaaaccctccagagaggctgtgcatgcctattgttaagcacatcgagtcactaggtggtgaagttaaacttaactctcggatacaaaagattcagttggaccagagtggaagcgtgaagagtttttgctaaataacgggagggaaatacgaggagatgcctatgttttgccaccccagttgacatcttgaagctgttactacccgatacttggaaggaaatctcatacttcaaaaagcttgagaaattagtgggcgttcctgtgattaatgttcacatatggtttgacagaaaattaaagaatacatatgaccatctactcttcagcaggagtcctcttttgagtgtctacgctgatatgtcggagacatgcaaggaatataaggatcctaatagatccatgctggaactggtttttgcacccgcggaggaatggatttcacgaagcgacactgatattatcgaggcaacaatgaaagagcttgccaagcttttcccggatgaaatcgctgccgatggaagcaaggccaagatccttaagtatcatgttgtgaaaacaccaaggtcggtttataagactgtaccggattgtgaaccttgtcggccgctgcaaagatcaccaatagagggtttctatttagctggtgattacacaaaacaaaatatttggcttctatggaaggtgctgtcttatctgggaagctttgtgcacaggctatcgtacaggattatgatctgctgagttctcgagcacaaagagaattggcggcgacaagcaatgtataaccctaaattgcttcgacatccgccatcgactttcattcgagatctggattgggaatctgatcatcgaataatgatcagctgtaaagaaaattgtgggggttgcatactggtgctgttcaagttcttgatgtacaaattctcctgaaagaagatttatttgtaatgatatatcaattgatagaaatatatatagcttacttctagggaattatgtatatgcaccattta

SEQ ID NO: 6 - DNA, 2117 bp, Amaranthus palmeri
ccctcttatcaatctatatccaaaactatttcattttccaaacttttttaaacccaaaaatcaaaacttttgattgaagaacaaactttgggggttttggaaaatgagtcattttggatatgcttgtgctactcaatccacatcaagatatgttcttttaggaaattcaaataaccccacttcaatttcatctattggaagtgattttttgggtcattctgtgagaaatttcagtgttagtaaagtttatggggaaagcaaagaaatgggcattgccctttaaaggttgtttgtatagattatcctaggccagagcttgaaagtacatccaatttcttggaagccgcctacttatcttctacttttcggaattcgcctcgtcctcagaagccattagaagttgtaattgctggagcaggtttggctggtttatccacggcaaagtatttagctgatgcaggtcacaaacccatattgttggaagcacgagatgttttaggaggaaaggttgcagcgtggaaggatgaggatggtgactggtatgagactgggctacatatattctttggggcatatccaaatgtccaaaatctatttggagaacttggtataaatgaccgactgcaatggaaggagcactctatgatttttgcaatgccagcaagcccggtgaattcagtcgctttgattttcccgaaatcctgcctgcaccattaaatggcatatgggcaatcctaaggaataatgaaatgctaacctggccagaaaaaatcaagtttgccattggcttgttgcctgctatggcgggcggacagtcatatgttgaagcacaagatggtttgagtgtccaagagtggatgagaaaacaaggagtacccgatcgtgtaactgatgaagtgtttattgccatgtcaaaggcactgaacttcataaatcccgatgaactttcaatgcagtgcatcttgattgctctgaaccgattcctgcaggagaaacatggttctaagatggccttcctagacggaaaccctccagagaggctgtgcatgcctattgttaagcacatcgagtcactaggtggtgaagttaaacttaactctcgtatacaaaagattcagttggaccagagtggaagcgtgaagagttttttgctaaataacgggagggaaatacgaggagatgcctatgtttttgccaccccagttgacatcttgaagctgttactacccgatacttggaaggaaatctcatacttcaaaaagcttgagaaattagtgggcgttcctgtgattaatgttcacatatggtttgacagaaaattaaagaatacatatgaccatctactcttcagcaggagtcctcttttgagtgtctatgctgatatgtcggagacatgcaaggaatataaggatccaaatagatccatgctggaactggtttttgcacccgcggaggaatggatttcacgaagcgacactgatattatgaggcaacaatgaaagagcttgccaagcttttcccggatgaaatcgctgccgatggaagcaaggccaagatcctcaaatatcatgtcgtcaaaactccaaggtcggtttataagactgtaccggattgtgaaccttgtcggccgctgcaaagatcaccaatagagggtttctatttagctggtgattacacaaaacaaaaatatttggcttctatggaaggtgctgtcttatctgggaagctttgtgcacaggctatcgtacaggattatgatctgctgagttctcgagcacaaagagaattggcggcgacaagcaatgtataaccctaaattgcttcgacatccgccatcgattttcattcgagatttggattgggaatctaatcatcgaataatgattagatgtaaacaaaattatgggggttgcatactggtgttcttcaagttcttgatgtataaattctccagaaagaagatttatttgtaatgatatatcaattgatagaaatatgtatagcttacttctagggaattatgtatgtgcaccatttgtaacttgattgaaatgtaagtatcaacttggtctcttgattgaaatgtaagtatcaacatctgtctcttatacacatct

SEQ ID NO: 7 - DNA, 14098 bp, Amaranthus palmeri
  unsure (1)..(14098): unsure at all n locations
ttgtgacatttttccacacaacatgtgatacctccagatttagcttgaaaagannttgatagactactcatatcaacaaggtgcatcttcttttcatgagagcccatttgctaagaattccacagttaagcgtgcttcatggagagcaatcttaggatgagtgaccttcgaggaagttttcctgggtgcgcacgggtgaggccaaagtgcgttaaaaagacttgtgttggtctgtggggcttgtctacagtctccatgagtagtcaccggcggtacgagaggccggggtgttacataaacagactcaaaggcgctaagccaagtagccaatagcaacatgtgtggcctgcggacagtcacaaaaacacacaatttcttatttttactctcttttatctcttttaggctttagccatcaacaataaaacaacatgataaagcaattcatttactgctaaattccaacaatttggtccctttttcctgttctttcagtttcacataccctcttatcaatctatatccaaaactatttcattttccaaactcttttaaacccaaaaatcaaaacttttgattgaagaacaaactttgggggttttggaaaatgagtcattttggatatgcttgtgctactcaatccacatcaagatatgttcttttaggaaattcaaataaccccacttcaatttcatctattggaagtgattttttgggtcattctgtgagaaatttcagtgttagtaaagtttatggaggaaagcaaagaaatgggcattgccctttaaaggttttctgccttttttttttttttgatgatttgattttctgggtagggataaatgataaagattgattcattttttttaaatgaataatttgtttttttgtatgatgcaggttgtttgtatagattatcctaggccagagcttgaaagtacatccaatttcttggaagccgcctacttatcttctacttttcggaattcgcctcgtcctcagaagccattagaagttgtaattgctggagcaggtgagtggaagggttctttacctattctgttgattagggtcttgttgtgttgctttttgctttgccaaattggatgctgttcttgattttctggagctttgggcaaaatagaagcaaaattgaaagctaattgagtcaattgagatgtttttgagaaatcatttattggccgttactgtttattagagaaaaaatatgggtcaagaaacgaaaagataatggaaaaactacttataggtgtcttttttgatcatgaatcatgatggatatatatggtgtcaactatcaagactgccatataactaatgtagtatgcttccttaaggggtggtgaagaatagacgtgtggatgagaaaattgctgggaatttcctatgcttatgtagaatgagcttcctcttgttgacattagtgaaaagtgaaaaattggtgtatgagtttgcttgatcgcttttgtgagtgcttcattgtccgttccacacctaggttatgttgtagggttgcaatatgttaaattgttagtgacggctgtcgtataacattattgtatcttatgccatgggccaaatttacccctattcaacgacgccatgcagacctaggtgtagtgaaaagtatgcaagggttaattggacatcaagcatggcgccatgttgtttgagtgtggcaaaaagactttacgctacacctctagaccagttaagtatgtaaagggtgttgggtcaccgctctaaagtggtgtgtcacattttatcgaattcgaggataagctgatcgtggtatcaagtgagaaagaacgcaatatagtggaattagaaagttaagtaataagaaaaaagaaaaaaatgatatctagctttaggaaaatctatcagtgaggagaatattgcaaaatacgtggaaattaaaaccaagacaaagctagcgatatatgagacaaagttaaaaatgtacaaagaaatatacgataagttgactcgaaagaagaggataacgatctttataggatagcctaaaggagacaaatgattataaacgatactagttgaatgaactatgaagagtgtcttaaccaagcaaatattgtttagaaataaattcaaaactttttaattcttcaaatatgaacatgagaactgacttctcattctttattttacttcaaggtttggctggtctatccacggcaaagtatttagctgatgcaggtcacaaacccatattgttggaagcacgagatgttttaggaggaaaggtgtgtgctatacgtttctcgtagcttatgaaacaaattcatcgtgcttattctcttattagtttatttcagactatcagatcatttttgaactttttcctccctctgttcggctgtattattatatatgtgcagcatgattaaaaaatgggtgcattaacatatatgaagttttttttttttatcaaggcgagattttgtcatccaaaaactttacttctgaacgtgctgtatgatcctgtttctgtatcttcatttgctgggattttctcgaggttcctgactgctttcagttattgtagttacccatcctgcataaatttgagtttacagttattgtaatgaaaataaatcggctaattatatcctcgtcacagtatgatgaatcttgggctagtaagaaaatgaggtaggaggaataattatggttagtttgataatatgtgccaagagaaatattgtagtgtaaagtttcattgtatttcttcccgtgcttataatttttgctccacaggttgcagcgtggaaggatgaggatggtgactggtatgagactgggctacatatattctgtgagtgatcttctaattttctgcttaattggccagttacccatgttcttacaatgcgctctctagtcgtgtttattggaaaatcgatgtactgaacatcttcatattttcttgaagttggggcatatccaaatatccaaaatctatttggagaacttggtataaatgaccgactgcaatggaaggagcactctatgatttttgcaatgcctagcaagcccggtgaattcagtcgctttgattttcccgaaatcctgcctgcaccattaaatggttagtatatcggtgataactgccaaattacttgatgcaatgcagtaccttgttaagtactttggatgtgactccacctataatacttgctataatcttcaatttatttctctttcctacattagaaactataagtatcccgctaaaggacatgaccccacttacaaagttacaataccccattaaaatacccactcacccactttttttaatcggtgtaccatccgcccgaggagcaatctcgaggggacagcagagtactactttagtgttattgtgatgaaataggtacctgcatcatatctcatgtcctgtggatacccataaatgaacgaaaaatttcatttttatacgtattatcctgctttagaagcttggaatatcattgaacttttttaatgtcccaacatgaaaacaatctgcatcttggtctgtttgctactcctaaatcctaatgagtcgggctgatttatgtctttgatgcttttgatcgtgtttcgcaggcatatgggcaatcctaaggaataatgaaatgctaacctggccagaaaaaatcaagtttgccattggcttgttgcctgctatggcaggcggacagtcatatgttgaagcacaagatggtttgagtgtccaagagtggatgagaaaacaagtaggagcagactttcgtttcagattttcctcattttgttaatggttctagacttctagctgtaaactttgactttgttgggacgtcaatgctgaaattttgtttgtgcattaatgcagggagtacccgatcgtgtaactgatgatgtgtttattgccatgtcaaaggcactgaacttcataaatcctgatgaactttcaatgcagtgcatcttgattgctctgaaccgattcctgcaggcatgactgcctttcattttctgctttaaatttttggttttgtacgatacttcttagtgcttgtttttgcgactattctcgagtaaataggggatataaaatgaccgtgctgtttttcataaactgaccttgggtaatgtatatcaacaggagaaacatggttctaagatggccttcctagacggaaaccctccagagaggctgtgcatgcctattgttaagcacatcgagtcactaggtggtgaagttaaactaaattctcgtatacaaaagattcagttggaccagagtggaagcgtgaagagttttttgctaaataacgggagggaaatacgaggagatgcctatgtttttgccaccccaggttttcttctctccctttttttaccattagttctctatcagactccgtaaaagctagagtaaagaaaatgaagattctattacagaaatggacacactgtaaagcttaattagttttgatcttgggcaaagcatttgtgtttccaaatttgttaatggttattatttaaatagaacacttatgtttgtgatgggtaacaaactaacaataggtcaagcgttgagccaaagtgttataacaatgattatatagtgtatatcatagtgtaaaattgcggtaaattgtggtaatggacgcaatcacagtgtcgggagtgattcggtatcataacgcctaaatatcggtcgaaaccataagctttgaaacggcccaaaacacggttttttttaaaaactttacgacgcgagaaatatcgttttgtttattttgaaaacctttacgaagcgacgatgcgatgcagccttgttttaactctatagtgtacataggaatatacaattaagcaaatagtcgtaagtgatatctcaaaagggacaagtgtgaaataggctaaagagttgaattaattgtgggattgacaattgtttcatcactggtcctctattgctttccttggtaaaatgttgcatacttgtttattgatttacactacatataattagttctgtagaatatgttcttgagtcaaagcatgggtcgatgtttgaggttgatgttggatttgcttgggcaagcaattacgaatatcttggtttaaggaacccatgaaaatggagcagcttgcaacgaaaacaaagcccagttgaaagcctgctcgggtgagcagcatcgcgttggggccagcatgatgagctgttcaaacacagaagttactggagtgctagtgctctggcaagcaagcacagcgcagcttacttttctttaatttttgattctatctagaattctaactaaaccctaatgcttacgattgattagtataattaaaacccataaagtgaatgagttgttcaaatacttgacaattgacattatttgagtggtcgtggatgtagtgttgtaacaaaattgtcacttatgagttaggaccatatccttgcgaaggtggagatacacttggtagaatacggtgaaaagtatcacctttccatagatagtatagcgttataagtgaatttattatattgtgctgtcatatcagtgtaacataatttgtagctaatccgctttttgaatacggaattcgctcgaaattgttgaaaaataacccaagaccgaccatattttgcttttttcggtttgcgattcgcagggagattagagaaccatgtaacattgtattttgatataatttttgaatttcattgtcagttgacatcttgaagctgttactacccgatacttggaaggaaatctcatacttcaaaaagcttgagaaattagtgggcgttcctgtgattaatgttcacatatggttagttaattcttcattctatattaaatttacttgttaggttttatacctaatcaactgcttttagttttgacattttgtccgacaataagtggacgtttctgttttgttgcgttttgtgaatttcttttgattacaggggctaattatataataatgcttcatgcaggtttgacagaaaattaaagaatacatatgaccatctactcttcagcaggtagtatttcgtttctttaatcatcctatttctctttcgtaacttaaataatctcgttcttccccttccctccttcacttcaacacttgtttcaattcttcatttttggtcgtagtaaaaactgatgaatatttgacaagagtcgcatcataagtaatatgaacattggaggagtgacaatcatcatctatgaagtataaactaagattctttgaagaaggggaaagtttaagtgaaaattttctttccattgggaaataagtcttttgattaacgtcttgaatagatgaaggatgcgaatttttggattcaaatgaagagaaacgttttatgtgatctagttgcgagtcgatggtgccttgaatttcttcaaaattgagcattttgttaatgttcgctttatttttgcactttcatgtccttttcttaaagttttatatggctatacattctcaatttagggcgacctcgatgcttaaacctttacaaacacacatcatataagaatgagagtgttaaaatttacctcttaatctcagtataaagtgtctcctttacttttgcacaaattttaggaacgtgtaagttaggatacaaattgaagttagggaatcttgtagggctcataaaaaatgacaatcacaaataactttctaaatatcgaaatgggtcacttgtggtgaactgatccaatatgaaaattagacacttgtgctaagatggagcaagtattataacttatgaaaacataatacttggggtggatgtacctttggtaggaaccatagtgccaaaatgcaattaacggttgcaattgcggtaacgacacgatgatgcgtttatcataactccaaatatcggctaaaagcatgagatattccttgtaccggcccaaaacacggtttttttacaccttcacatcacgagaaatatcgtttttttgaaaatctttagaacacggccgatgcattgcgatgcgaccttatttttgcactatggtagggacaacatttgcggatgcacacattggataccgtttctgacccccttttcacttttacagatcctatggatataagtatgttactgattctaaaacttcattccctaggattaaatgtagaaaccatataaggatggatctttaagatacttttatctatatcctttcctgaaccctattaaatatctatggcctacaagaggtggtcacaattcatcatcctcttcgtccacttcatgcattttaaacatatcttcgagttctcctttaattgtttatctttgttatttcaggagtcctcttttgagtgtctatgctgatatgtcggagacatgcaaggtgagcatattcccatttgtcgctcttttgatttctgacttgtatgttctggttctccatttgtcgctctttcgcgcgtataatttcgaatgttagccactccccgtcactcctcccattctgcaatcaccgggattttaactatgagggtccttagaatcgattataaaaattcgacaaaaacaaaaaaaaaagacataaaattgacgggccataacaattttacataagatattcaacattttttttgcgaattttcttaataaattccgtaattccgtacatctatactcccgagccccttcatgtgtgcgctgcggctttaagaaacctttcttataagtgttgactgtatgagctgacaggctgtcttttccgtcccaataatcatttacaggaatataaggatccaaatagatccatgctggaactggtttttgcacccgcggaggaatggatttctcgaagcgacactgatattatcgaggcaacaatgaaagagcttgccaagcttttcccggatgaaatcgctgccgatggaagcaaggccaagatcctcaaatatcatgtcgtcaaaactccaaggtgattgataagcttgtgaaattaaaattggataattttatgctaccgctagaaacagcattaatgttgtgcccgcgggctcttttataggtcggtttataagactgtaccggattgtgaaccttgtcggccgctgcaaagatcaccaatagagggtttctatttagctggtgattacacaaaacaaaaatatttggcttctatggaaggtgctgtcttatctgggaagctttgtgcacaggctatcgtacaggtaatcaaattttgatggaacaccgcgtgcatgctgagtagactttttgtgttttgatttgttctgaaattgacccaaaaccgaccggaaatcatgggttataactcggaaaatatgacccgtaacctgaaaatgactcaaaacccaccgtagcccaaatccaaccgtttcgacttgtttacctaattttgtcaacttttcttgttccacatcgttaattttctgtcggaacccactttctttctagtctatttttgtatttcttttttctttgttgattcttttattcgtttatacctagttatgttttttttttttgaaaatttggaatagattaataaaaggaggaaaagaaacacaacactgtaacttgggacaccaaacctagttatgtttatatatttatatgtattttatatatttatatgcttttgactactgaggtattatgatagtttctatgagcgtgatatactgggtatgaagatgatttattcttttttaataaaaaagtttaggtcttttttgaaaacattttagtgattttttctaaacttgtaacccgatcgaaattcaatccgaaccaaaaataacccgatcgaaagtgactcaacccaaaagcttccctgatctaattgtgatgatagctttgaaattttcatcgttttagtcaaaaagttctgttgagtagtttaaataactggttcacattttgtaattatatgcaggattatgatctgctgagttctcgagcacaaagagaattggcggcgacaagcaatgtataaccctaagttgcttcgacatccgccatcgattttcattcgagatctggattgggaatctgatcatcgaataacgatcagctgcaaacaaaattatgagggttgcatactggggctgttcaagttcttgatgtataaattctccagaaagaagatttatttgtaacgatatatagaaatatgtatagcttacttctagggaattatgtatgtgcaccatctgtaacttgattgaaatgtaagtatcaacttggtctcttgattgaaatgtaagtatcaacataatacaaatttataccaatacatttatttcccttttttgtttaattatgtgttttttgttgttttttatttgtaactagagtcactcatactccaacggtctgtctggtttgtggtattaaacggtggtgatgagaataaaaactagtgtaattttgattaaaaattctcttgctattttgatggccatggttgtgtttgatgagaaggaatatgaaaactagtgtaggtggtattaaacagtgccacggtggtaatgagaatgaaaactagtgtaatttgggttaaaaaaatctcttgtctttaatcatctcattttctttataaatttcaatccaatgcattactatcgggagagatggtatcaggtggtaatggaaatttgtaaataaaaagaaaaattttgtgatcaaagtttcatcgctataaagcattctcattaccaccatttagtaccactaatcaaacaggccgcaagagctttagcgttggcttccattggatgattatgggggttaacgagtctgttaaggtgcccattattatctatatgtagttgtcttccattgaaacttgataagtaacttctaccattaccaagtgtttgtatatgaatcattttttttttctctttgtctgggttgttcagactcacttttaaaattcttcttcattagcaagtccattagacttgtttcagtgcacttctgattatagtgtaaacagaaacaaggttgcatcacatcaaccacgttgtaaagattttcaaaacagacgaattgatatttttcgcgttaccgcatttttacatatcaagtagctgtttattcaaggattaacaactcatataaagtatcataagcttatcaatatctttatgatttatgaatggagtaataagagaagttaacttatcttggtttagactcttgagcggagccgtacaattacaaatcattgacatacatgatacattgcatagggacccatcaaaaaatcaaaaaggaagacgattgatcctaaacggaaacgaatgaaattaaaagagagtaaaaaaaacacattaattttagaggttttatatattttatatattttttttgtaattttagagcctaaaaataagttattatactccgtcaaagttagtataaactaacgttaacaaatatttgaagctcccttaatttatggagttctatgtgattggacatcttacacatgctcagaaccacacctgaatacaaaatatcaatataattctggtatccgagctgatagttcgatcaaaaattaaaaaggtgggtccaaaaagaatgttgtccctaccctaagggctaacagtgtgtttggcaagagggacttgaggttggggaatgagatttttgggtaagattataaaaagtctcttatttgtttaaggggattgagaaaagatgagacttgagacttagaaaggaaaagtccccaaaaaatgtcttggtgggagggcagtatttggggatgaaacttagaaaatttataaaaagacaattttgccataaatgtaaagaaatctaagagttataaggacaattttgtaaatataatcgatttttatttaatttcttatctatttttatcatttgactgacaacgacataagacatttattttcaaagtctcaactcaagtctcaacctaaagtctcattctaagtctcgactataatctcataatttccattcccacatgccaaacaccccctaattgattactcccacgttcaaacttgacgggattcacatgtaaaagaaaatgttgagacagtttatcccatattgataaattaaagatgttgtgcacactttataattcattaaaactagaggtgctcattcgggtcatcgggttgatttcaggttatgtgtttcaggtcggttcaaaatcgggatttgtgttcacattggcttttacataattatagatccacttttaaatcgggtctaatcgggttcgattataaagtcggatgtctatcgggtcatcgggtatgttttgaacacctctaattaaaacccatcccttccgatctaacttaacattcatgtacctcgttaaaccacaaaatctgtttctaagcttgtaatttcaacaaaatctaaccaacttaagtcttaagttaaaaaccaagaggaaaagggcggtttcaatcttcaatctcgagtggacgccataactaatggctgatgcagatcatctcacattcttaacatttcaattcactgaatcttgggattttggtgtttaaaaacaagatcatggtaatcctttaaaccttaaattgtaattaaagtcattaaatttgtggttttgatgtattcaacgtttaaagtatttaatttacccaagatcaggtagtgggggattgtgcatttgtgcatcagatcagtacaggattaatgtgcagcaacagttcattcgagtcttagagggtgagcgaggggattgactatataatatagggccgtcttattcttccgtatgaaaaagttaacaagaaatgtatgttaagtctattaataaaataaaaatattactacaaataaagtgcaaataaaagttttacacagggcccctaaatttttcaaaacggctctcagccacacaagtagacagtcatcagccgagtacttcctccgtctaacaaattgtgacagtgaggataaatatagttaattatgtccaaaatttataatataaatataaagatttcgtaggtgaactgtaaataaatcaacccaaaataacaatacaaatttttgtgagagatggtctctttgagagaccatctctagttgggcggctcattatatattttttaaaatattgtaagtaggcattaggaatgatctaagtatacatttaagatattgaaagtaggcattaaggatacgataataagtaagcactaaggataatgttagtagacattaaaaatatgataaatagacattaatctttaatgggttggacttgagatatatttttcaaagagacgatctctcaagagattagctgaaataccaatgagaacaaatttaacaaacgaaaagagtaataaatatatgaggagttaaaacttaaaatgcatgtgagaacaaaaatgcaagaaaatgatgaaacatttttataaaggagaattgtagcaaaataaaaagaatgaacaaaagtaaaaggtatttcctctgtttcataatcgttgctagcgttagtgacattttctaacataacatgtcacactaatggagaaagtatttgacaagtctcttagtcaattgaaagcatatttcttaggaaaaagatgagctgagtttgttcagtgatttgatgatgtgatcaaatcattagtgaatcagtgaaaccatactcatgattatatgattacaactttaacaaacaagtaaatattgcatctttggagatatcaatgagtcaattgactaatgaatgttctaaaagactaaacacaaaagattgcaccaactcataacaccccatctatctatctttttaatttagtatcattttttattttgggttattcgtctcatttgtattaataatacatcactttctttgaaccttattcatacattttaaccctttttttaatatcatccacgcaattcaatctcttttggcttattaccaataagactcaaaaaaatgtacgaccttaacaaagaaatttattgtcgattaaatcatcatcatcatcatacccagtgtatctcgctcattattgtcgattaaatcttaatagaaaatattatgtacaacttcacataaataataaattagaaatactcataatttagtaagtcattttactatacttcatataaatataaagaattttaataaaattttccatcacctcttattatcggaaattctctaacctgcacccgagtcaaaaaattaaaaaaataataaattgcaaaagcaaaaacctttatcaaccacaagactgaaaaaatagtaattaatttgtcaccaaagatatattatatgaataataactaattagtgttgttttttaggatatatgcatttaaaaaatgttaccttatgattagcaaaatcaagcaacaaaactatatgatgatttaagtttgtctcatttgagaccatccaacaagaagtcatgtggaaaatcctaaactatagtgattagaaagactagtataccaaatctttgaataagatgacaaaagatattgattaaactaatcttaattagctatatccaaaatatttggcgatttatggcgtttgataaatgactgatagctggtagttgataactgattatagtgactgatttgatcagttgattttattaactgtttcaaccagttaattcaccaaagactagcattagctggtttgaccacccaacccttatttatatcaaaataagctaaaattacccaataagctaatttgtcaaatacccgtgtatattatgtaagtttgagagtaaaaatatttttttttagaaaaaatattaatttaacttttacttatcttgcctttcctcggcctatcgattcagtaataaaaaaaattctctcaatataatgttatagaaatatactctctctgttcttttaagtttgttcacattactctaacgggcagtttcatatgtttgtcctatttagaatacttttctattttggaaagtttttatcttccatgtgctctctttatccctcatttaaccc

SEQ ID NO: 8 - DNA, 8797 bp, Amaranthus palmeri
agggataaatgataaagattgattcattttttttaaatgaataatttgtttttttgtatgatgcaggttgtttgtatagattatcctaggccagagcttgaaagtacatccaatttcttggaagccgcctacttatcttctacttttcggaattcgcctcgtcctcagaagccattagaagttgtaattgctggagcaggtgagtggaagggttctttactcattctgttcattagggtcttgttgtgttgctttttgctttgccaaattggatgctgttcttgattttcaggagctttgggcaaaatagaagcaaaattgaaagctaattgagtcaattgagatgtttttgagaaatcatttgttggccgttactgtttattagagaaaaaatatgggtcaagaaacgaaaagataatggaaaaactacttataggtgtcttttttgatcatgaatcatgatggatatatatggtgtcaactatcaagactgccatataactaatgtagtatgcttccttaaggggtggtgaagaatagacgtgtggatgagaaaattgctgggaatttcctatgcttatgtagaatgagcttcctcttgttgacattagtgaaaagtgaaaaattggtgtatgagtttgcttgatcgcttttgtgagtgcttcattgtccgttccacacctaggttatgttgtagggttgcaatatgttaaattgttagtgacggctgtcgtataacattattgtatcttatgccatgggccaaatttacccctattcaacgacgccatgcagacctaggtgtagtgaaaagtatgcaagggttaattggacatcaagcatggcgccatgttgtttgagtgtggcaaaaagactttacgctacacctctagaccagttaagtatgtaaagggtgttgggtcaccgctctaaagtggtgtgtcacattttatcgaattcgaggataagctgatcgtggtatcaagtgagaaagaacgcaatatagtggaattagaaagttaagtaataagaaaaaagaaaaaaatgatatctagctttaggaaaatctatcagtgaggagaatattgcaaaatatgtggaaattaaaaccaagacaaagctagcgatatatgagacaaagttaaaaatgtacaaagaaatatacgataagttgactcgaaagaagaggataacgatctttataggatagcctaaaggagacaaatgattataaacgatactagttgaatgaactatgaagagtgtcttaaccaagcaaatattgtttagaaatagattcagaactttttaattcttcaaatgtgaacgtgagaactgacttctcattctttattttacttcaaggtttggctggtttatccacggcaaagtatttagctgatgcaggtcacaaacccatattgttggaagcacgagatgttttaggaggaaaggtgtgtgctatacgtttctcatagcttatgaaataaattcatcgtggttactctcttattagcttatttcagactatcaaataatttttgaactttttcctccctctgttcggctgtattattatatatgtgcagcatgattaaaactgggttcattaaaatatatgaagttttttttatcaaggcgagattttgtcatccaaaaactttacttctgaacgtgctgtatgatcctgtttctgtatcttcatttgctgggattttcttgaggttcctgactgctttcagttattgtagttacccatcctgcataagtctgagtttacagttattataatgaaaatgaatcggctaattatatcctcatcacagtatgatgaatcttgggctagtatgaaaatgaggtaggaagaataatttgggttagtttcgtaatatgtgccaagagaaatattgtagtgcaaagtttctttgtatttcttctcgtgcttatattttttgctccacaggttgcagcgtggaaggatgaggatggtgactggtatgagactgggctacatatattctgtgagtgatcttctaattttctgcttaattggccagttacccatgttcttacaatgcgctctctagtcgtgtttattggaaaatcgatgtactgaacatcttcatattttcttgaagttggggcatatccaaatatccaaaatctatttggagaacttggtataaatgaccgactgcaatggaaggagcactctatgatttttgcaatgcctagcaagcccggtgaattcagtcgctttgattttcccgaaatcctgcctgcaccattaaatggttagtatatcggtgataactgccaaattacttgatgcaatgcagtaccttgttaagtactttggatgtgactccacctataatacttgctataatcttcaatttatttctctttcctacattagaaactataagtatcccgctaaaggacatgaccccacttacaaagttacaataccccatgaaaatacccactcacccactttttttaatcggtgtaccatccgcccgaggagcaatctcgaggggacagcagagtactactttagtgttattgtgatgaaataggtacctgcatcatatctcatgtcctgtggatacccataaatgaacgaaaaatttcatttttatacatattatcctgctttagaagcttggaatatcattgaacttttttaacgtcccaccatgaaaacaatctgcatcttggtctgtttgcaactcctaaatcctaatgagtcgggctgatttatgtctttgatgcttttgaccgtgtttggcaggcatatgggcaatcctaaggaataatgaaatgctaacctggccagaaaaaatcaagtttgccattggcttgttgcctgctatggcaggcggacagtcatatgttgaagcacaagatggtttgagtgtccaagagtggatgagaaaacaagtaggagcagactttcgtttcagattttcctcattttgttaatggttctagctgtaaactttgactttgttgggacgtcaatgctgaaattttgtttgtgcattaatgcagggagtacccgatcgtgtaactgatgatgtgtttattgccatgtcaaaggcactgaacttcataaatcccgatgaactttcaatgcagtgcatcttgattgctctgaaccgattcctgcaggcatgactgctttttaatttccgctttaaatttttggttttgtacaatacttcttagtgcttgtttttgtgacttttctcgagtaaataggggatgtaaaatgaccgtgctgtttttcatgaactgacgttgggtaatgtatatcaacaggagaaacatggttctaagatggccttcctagacggaaaccctccagagaggctgtgcatgcctattgttaagcacatcgagtcactaggtggtgaagttaaactaaattctcgtatacaaaagattcagttggaccagagtggaagcgtgaagagttttttgctaaataacgggagggaaatacgaggagatgcctatgtttttgccaccccaggttttcttctctccctttttttaccattagttttctattagactcagtaaaagctagagtaaagaaaatgaagattctattacagaaatggacacactgtaaagcttaattagttttgatcttgggcaaagcatttgtgtttccaaatttgttaatggttattatttaaatagaacacttatgtttgtgatgggtaacaataggtcaagcgttgagccaaagtgttataacaatgattatatagtgtatatcatagtgtaaaattgcggtaacggacgcaatcacagtgtcgggagtgattcggtatcataacgcctaaatatcggtcgaaaccataagctttgaaacggcccaaaacacggttttttttaaaaactttacgacgcgagaaatatcgttttgtttattttgaaaacctttacgaagcgacgatgcgatgcagccttgttttaactctatagtgtacataggaatatacaattaagcaaatagtcgtaagtgatatctcaaaagggacaagtgtgaaataggctaaagagttgaattaattgtgggattgacaattgtttcatcactggtcctctattgctttccttggtaaaatgttgcatacttgtttattgatttacactacatataattagttctgtagaatatgttcttgagtcaaagcatgggtcgatgtttgaggttgatgttggatttgcttgggcaagcaattacgaatatcttggtttaaggaacccatgaaaatggagcagcttgcaacgaaaacaaagcccagttgaaagcctgctcgggtgagcagcatcgcgttggggccagcatgatgagctgttcaaacacagaagttactggagtgctagtgctctggcaagcaagcacagcgcagcttacttttctttaatttttgattctatctagaattctaactaaaccctaatgcttacgattgattagtataattaaaacccataaagtgaatgagttgttcaaatacttgacaattgacattatttgagtggtcgtggatgtagtgttgtaacaaaattgtcacttatgagttaggaccatatccttgcgaaggtggagatacacttggtagaatacggtgaaaagtatcacctttccatagatagtatagcgttataagtgaatttattatattgtgctgtcatatcagtgtaacataatttgtagctaatccgctttttgaatacggaattcgctcgaaattgttgaaaaataacccaagaccgaccatattttgcttttttcggtttgcgattcgcagggagattagagaaccatgtaacattgtattttgatataatttttgaatttcattgtcagttgacatcttgaagctgttactacccgatacttggaaggaaatctcatacttcaaaaagcttgagaaattagtgggcgttcctgtgattaatgttcacatatggttagttaattcttcattctatattaaatttacttgttaggttttatacctaatcaactgcttttagttttgacattttgtccgacaataagtggacgtttctgttttgttgcgttttgtgaatttcttttgattacaggggctaattatataataatgcttcatgcaggtttgacagaaaattaaagaatacatatgaccatctactcttcagcaggttgtatttcgtttctttaatcatcctatttctctttcgtaactcttaaataatctcgttcttccccttccctccttcacttcaacttgtttcaactcttcattttcggtcgtagtcaaatttgatgagtatttgacaagagttgcatcataagtaatatgaacattggaggagtgacaatcatcatttatgaagtattaactaagattcctttaagaaggtgaaagttttaagtgaaaattttctttccattgggaaataagtcttttgattaatgtcttgaatagatgaaggatgcgagtttttggaatgaagagaaacgttttatgtgatctagttgcgagtcgatagtgccctgaatttcttcaaaattgagcatttttgttatcgttcgctttatttttgcactttcatgtccttttcttaaagttgtatatgacttttcattctcaacttaggcttacctcgatgcttaaagtgtctcctttacttttgcccaaattttaggaacgtgtaagttacaggatacaaattaaagttagggaatcgtgtagggctcgtaaaaaatgacaatcaccaataactttctaaatatcaaaatgggtcacttgtggtgaactgatccatatgaaaattagacacttgtgctgagatggagcaagtattataacttatgaaaacataatacttggggtggatgtacctttgttaggaaccatagtgccaaaatgcaataacgccataacggtaacgacacgatgatgcgtttatcataactccaaatatcggctaaaagcatgagatattccttgtaccggcccaaaacagggtttttttacacctttacattatgagaaatatcgtttttttttttttttgaaaatctttagaacacgaccgatgcagcgcgatgcgaccttatttttgcactatggtagggacagcatttgcggatgcacacattggttaccatttctgacccccttttcacttttacagatcctatggatataagtatgttactgattctaaaacttcattccctaggattaaatgtagaaaccatataaggatggatctttaagatacttttatctatatcctttcctgaaccctattaaatatctatggcctacaagaggtggtcacaattcatcatcctcttcgtccacttcatgcattttaaacatatcttcgagttctcctttaattgtttatctttgttattccaggagtcctcttttgagtgtctatgctgatatgtcggagacatgcaaggtgagcatattcccatttgtcgctcttttgatttctgacttgtatgttctggttctccatttgtcgctctttcgcgcgtataatttcgaatgttagccactccccgtcactcctcccattctgcaatcaccgggattttaactatgagggtccttagaatcgattataaaaattcgacaaaaacaaaaaaaaaagacataaaattgacgggccataacaattttacataagatattcaacattttttttgcgaattttcttaataaattccgtaattccgtacatctatactcccgagccccttcatgtgtgcgctgcggctttaagaaacctttcttataagtgttgactgtatgagctgacaggctgtcttttccgtcccaataatcatttacaggaatataaggatccaaatagatccatgctggaactggtttttgcacccgcggaggaatggatttctcgaagcgacactgatattattgaggcaacaatgaaagagcttgccaagcttttcccggatgaaattgctgccgatgggagcaaggccaagatcctcaaatatcatgtcgtcaaaactccaaggtgatcgataagcttgtgtaattaaaattggataattttatgctaccgctagaaacagcattaatgttgtgcccgcgggctcttttataggtcggtttataagactgtaccggattgtgaaccttgtcggccgctgcaaagatcaccaatagagggtttctatttagctggtgattacacaaaacaaaaatatttggcttctatggaaggtgctgtcttatctgggaagctttgtgcacaggctatcgtacaggtaatcaaattttgatggaacaccgcgtgcatgctgattagacttttcgtattttgatttgatttgaaattgacccaaaaccgaccggaaattagtgggttacttataactcagaaaatatgacccgtaacctgaaaatgactcaaacccaccgtagcccaaatccaaccgttttgacttgtttacctaattttgtcaacttttcttgttccaagtcattagttttctgtcggaacccactttctttcgagtctttttttgtatttcttttatcttcgttgatgcttttattcgtttatacctagttatgttgatatatttatatgtatatatttatttatatgctttttactactgaggtatgatgttctagagtatgatgatgatgatttattctttttatattaaaaaaaaagtttaggtctttttgaaaacattttagtgattttttctaaacttgtgacccgatcgaaatttgatccgaaccaaaaataacccgatcaaaagtgactcaacccgaaacctaccctgatctaattgtaatgatagctttgaaatttttatcgttctagttaacaagttctgttgaagttaatataaatctcgaacgttcctataaacttattttttagattgtcaaggttagttagttgtatagaagttaagtagcttaaacaactagtccatattttgtatatgtgtaggattatgatctgctgagttctcgagcacaaagagaattggcggcgacaagcaatgtataaccctaaattgcttcgacatccgccatctattttcattcgagatttggattgggaatctgatcatcgaataacgatcagctgcaaacaaaattatgagggttgcatactggtgctgttcaagttcttgatgtataaattctccagaaagaagatttatttgtaatgatatatcaattgatagaaatatgtatagcttacttctaaggaattatgtatgtgcaccatttgtaacttgattgaaatgtaagtatcaacttggtctcttgattgaaatgtaagtatcaacataatacaaatttataccaatacatttatttcccttttttgtttaattatgtgttttttgttgttttttatttgtaactagagtcactcatactccaacggtctgtctggtttgtggtattaaacggtggtgatgagaataaaaactagtgtaattttgattaaaaattctcttgctattttgatggccatggttgtgtttgatgagaaggaatatgaaaactagtgtaggtggtattaaacagtgccacggtggtaatgagaatgaaaactagtgtaatttgggttaaaaaaatctcttgtctttaatcatctcattttctttataaatttcaatccaatgcattactatcgggagagatggtatcaggtggtaatggaaatttgtaaataaaaagaaaaattttgtgatcaaagt

SEQ ID NO: 9 - DNA, 1788 bp, Amaranthus palmeri
ttgaaagcctgctcgggcacgacactgtagggctcgggcgagcagcatcgcgttggggccagcatgatgagatgttcaaacacagaagttactggagtgctagtgcgcggcttacttttctttaattttgattctatctagaattctaactaaaccctaatgcttacgattgattagtataattaaaacccataaaatcttcagatttttcaccacaaaatatttgagcttagtaatctacaagaaatcttcaaacacatcaaatctagttgtctctcattctctattgtaattcttattattacgagttcttgtgttcaagaactacaagtttgattattaatcaacccaagaagttcgccaaggaggatgtagcccaaactgggtgaacctcggtaaatctttgaattcttccttgctttctactaattaattgcgaatgagtatgtaagatattgcattatatttttcatattcaacaaaagcattctactaccaatcttcgtcttgtaattcgcttttgcaacgttgtccttcaactagtgaatgagttgttcaaatacttgacaattgatattatttgagtggtcgtggatgtagtgttgtaactaaattgtcacttatgagttaggaccatatccttgcaaaggtggagagatcacttggcagaattcggtgaaaagtagcacctttccatagatagtatagcgttatgagtgaatttattatattgtgttgtcttatcagtgtaacataatttgtagctaattcgctttatgaattcggaattcgctcgaaattgttgaaaaatagcccaagaccgaccatattttgcttttttcgatttgcgatccgcagggagattagagaaccatgtaacattgtattttgatataatttttgaatttcattgtcagttgacatcttgaagctgttactacctgatacttggaaggaaatctcatacttcaaaaaacttgagaaattagtgggcgttcctgtgattaatgttcacatatggttagttaattcttcattctatattaaatttacttgttaggttttataccttatcaactgcttttagttttgacattttgtccgacaataagtgggcgtttctgttttgttgcgttttgtgaatttcttttgattacaggggctaattatataataatgcttcatgcaggtttgacagaaaattaaagaatacatatgaccatctactcttcagcaggttgtattttgtttctttaatcatccatttctctttcgtaacttaaataatctcgttcttccccttccctccttcacttcaacacttgtttcaattctttcattttcggtcgtagtaaaaattgatgtatatttgacaagagttgcatcataagtaatatgaacattggaggagtgacaatcatcatttatgaagtataaactaagattcctttaagaaggtgaaagtttaagtgaaaattttctttccattgggaaatagtcttttgattaacatcttgaatagatgaaggatgcgagtttttggaatgaagagaaatattttatgtgatctagttgagagtcgatggtgccttgaatttcttcaaaattgagcattttgtgaacgttcgctttatttttgcactttcatgtccttttcttaaaagtagtatatggcttttcattctcaacttaggcttacctcaatgcctaaacctttacaaacacacatcatataagaatgagtgttaaaatttacctcttcatctcagtaaagtgtctcatttactt

SEQ ID NO: 10 - DNA, 1277 bp, Amaranthus palmeri
acccataaggagagggcggtcacaagagtccttcggttaagaggagtcttcaaggataagacctgcaaatatccgaaaacctagtacctatggactataattgtgttggataaaataacaattagttcatattggactataattttaccctagtgcctatggaagattggggaaataatttaatcatactccttttttattcatcttttttatttattctcatgctatttctttcacaatgtttcaattacctcacttgcacttctactggcctttatttcaataatttaactttttttcacccttcaatatttacaatcaatccaagcgagcactaagaaaaaaaacatttggcttgatatatactaatttaccataataaaatccaaacctgccaaaaaaacatttagttattaaaaatgctatgaaaatagtctttttttttctcaagtgaagttctgtaaattaaaaaaagaaaagcaaagtaaattacctggaccgttgttgcggtggaggaaagttccaacgggacttttgatcttagtaccaaacaccggttcaatgaagttcaagaataccgactcatcattgttggctaaaaccacagcctgaagtgctgaatcagctacaccaagcagatcatccgcactaaactcagcaaactcatgaaacccacttatctttcttacatactcccacaccgggtttaactcttccacacaacttgcagcatggtctattccctttatcccaaactcctctactcttccaacctctactcttgcaaacttagcaagccgccacaaattaccccactctttttcattttcagatgaatggctcacaaatcgtaggactacgtcattatacagaatgacttccgcaagcatcgtgtgtccgtcttcaagcaggacaggcggggctgacggattagctcctgcagcaacgctaatcctaaaggcggattcagcgttctccacttcaagggccacagcgcgaacaccaagcccatgagaacacacaaaagaggcgtgcgcactgtggtcaaatgtaggaattgaagcagtgttgagcttagatgaagcagagtaaggagccgtgaatacgaaacaaaggtcgccactacgtaagacgtaggaggcatgtacaaggttgcctgtcgagagatcggatttggcaaccaaaggcatgccaagccctaacgaaaataaaaggctagtgttggttgcatcaccacaccagaactcaatgtggtggaaccttttcactttgaaatg

SEQ ID NO: 11 - DNA, 1241 bp, Amaranthus palmeri
  unsure (1)..(1241): unsure at all n locations
gatatactgggtatgaagatgatttattcttttttaataaaaaagtttaggtcttttttgaaaacattttagtgattttttctaaacttgtaacccgatcgaaattcaatccgaaccaaaaataacccgatcgaaagtgactcaacccaaaagcttccctgatctaattgtgatgatagctttgaaattttcatcgttttagtcaaaaagttctgttgagtagtttaaataactggttcacattttgtaattatatgcaggattatgatctgctgagttctcgagcacaaagagaattggcggcgacaagcaatgtataaccctaagttgcttcgacatccgccatcgattttcattcgagatctggattgggaatctgatcatcgaataacgatcagctgcaaacaaaattatgagggttgcatactggggctgttcaagttcttgatgtataaattctccagaaagaagatttatttgtaacgatatatagaaatatgtatagcttacttctagggaattatgtatgtgcaccatctgtaacttgattgaaatgtaagtatcaacttggtctcttgattgaaatgtaagtatcaacataatacaaatttataccaatacatttatttcccttttttgtttaattttgtgttttttgttgtttttaatttgtaactagactcactcatactccaacggtccgtctggttggtggtattaaatggggtaatgagaataaaaattagtgtaattttggttaaaaaatctcttgctatcttgatggccatgcttgtatttgatgagaaggaatatgaaaactagtgtaggtggtattaaacagtgtcacggtggtagtgagaatgaaaactagtgtaatttgggttaaaaaatctcgtctttagtcatctcattttcttcagaaatttcatctcaatgcattactatcgggagagatggtattaggtggtnnnnnaaatttgtaaataaaaaaaactttttgtgatcaaagtatcatcactataaatcattctcattannnnnnnttagtaccactaatcaaacaggccgcaagagctttagcgttggcttccattggatgattatgggggttaacgagtctgttaaggtgcccattattatctatatgtagttgtcttccattgaaacttgataagtaacttctaccattaccaagtgtttgtatatgaatcattttttttttctctttgtctgggttgttc

SEQ ID NO: 12 - DNA, 714 bp, Amaranthus palmeri
ctaattatataataatgcttcatgcaggtttgacagaaaattaaagaatacatatgaccatctactcttcagcaggttgtattttgtttctttaatcatcctatttctctttcgtaacttaaataatctcgttcttccccttccctccttcacttcaacacttgtttcaattcttcattttcggtcgtagtaaaaattgatgtatatttgacaagagttgcatcataagtaatatgaacattggaggagtgacaatcatcatttatgaagtataaactaagattcctttaagaaggtgaaagtttaagtgaaaattttctttccattgggaaatagtcttttgattaacatcttgaatagatgaaggatgcgagtttttggaatgaagagaaatattttatgtgatctagttgagagtcgatggtgccttgaatttcttcaaaattgagcattttgtgaacgttcgctttatttttgcactttcatgtccttttcttaaaagtagtatatggcttttcattctcaacttaggcttacctcaatgcctaaacctttacaaacacacatcatataagaatgagtgttaaaatttacctcttcatctcagtaaagtgtctcatttacttttgcacaaatttaaggaacgtgtaagttagaggatacaaattaaagttagggaatcttgtagggctcataaaaaatgacaatcaccaa

SEQ ID NO: 13 - DNA, 367 bp, Amaranthus palmeri
tgggttttaatattaatccagggagagggtctgggtcgtccatttattgttttgggacacgacattggaccagatccgttgagtctcaaaacattggactcatagcctaaaaataggtgtagggataggacatatccaataaagtcttggacccataagcgtacatccctaatatgtagtactagaatattttatatgttaaacattaaatgcatgacttctgattcctcgggtctagtaatagagtattcttagggctcgcctgaattgtgtataaatatttaagaggtaaataaaagttaaagtaggaagataaagttaattaaatagaagattaaaggcattaaattgtcgtcatcatcatcat

SEQ ID NO: 14 - DNA, 221 bp, Amaranthus palmeri
agcttggtataaatgagcgattacaatgaaaggagcactctatgatttttgctatgccaagcaatcctggtattttcagtcttttttttattgaagtcctcccaggctccaacaacatttaacgtttagtttggtaataaaattcgcaaaatgtctgtatttagcgaaagtcaaactactcctaatgactttcacgagtctcttcatcaagatgtttggtg

SEQ ID NO: 15 - DNA, 133 bp, Amaranthus palmeri
tgactctccatttgatctaaatagaatttcaactcttttgtagttgacgaagtccaaattagttggagtgtgtatattgaaatgcatgaactcttatgctactatttatatactttttccgtttcataatact

SEQ ID NO: 16 - DNA, 2132 bp, Amaranthus rudis
gccttttgaatgtacatattctattcttgtaatcatttgatcagccaacattaagaccgttttcaatgagaacttccttccgcaatacacaaaaagatcctcaagactaggccctaataaatcaatcacgagaatattatcttccccatccactccagaccatttcacagttggaatcccacttcctccttgaagaatggtgtataccttcgcctcatacagtaattgcggatgcttcgtcttggtattctcgagctttacagcgacaatctcgaaggtgtcgatatgagtagcaaggaaaatttcaccgaaggaaccactgccgatcttgcgacctagcttgtacttgcctccgacgatccgatccataacgatttcgataaattaaacaaccaaaactaccaccgttgaaattgattgatatggtgaaatcaatagcgtgaaattgaaaacataagttaggattttggatagataaaggggaaagtaggtgccgatgaagggaagagagagaaaactcaagctaaaagcgggtaagcagacatccagagagagaaagagaaagacgatgagtgtatgaggtggagttttggggatttttaattagggaaagggaaggaaggtggaaatgggaggaattctttggggcttatccaaatatccaaaatctatttggagaacttggtataaatgatcgattgcaatggaaggagcactctatgatttttgcaatgcctagcaagcctggtgaattcagtcgctttgattttcccgaagtcctgcctgcaccattaaatggcatatgggcaatcctaaggaataatgaaatgctaacctggccagaaaaaatcaagtttgccattggcttgttgcctgctatggctggcggacagtcatatgttgaagcacaagacggtttgagtgtccaagagtggatgagaaaacaaggagtacccgatcgtgtaactgatgaagtatttattgccatgtcaaaggcactgaacttcataaatcccgatgaactttcaatgcagtgcatcttgattgctctgaaccgattcctgcaggagaaacatggttctaagatggccttcctagacggaaaccctccagagaggctgtgcatgcctattgttgagcacattgagtcactaggtggtgaagttaaacttaactctcgtatacaaaagattcagttggatcagagtggaagcgtaagagttttttgctaactaatgggagggaaataagaggagatgcctatgtatttgctaccccagttgacattttgaagctgttgctacccgatacttggaaggaaatctcatacttcaaaaagcttgagaaattagtgggcgttcctgtgattaatgttcacatatggtttgacagaaaattaaagaatacgtatgaccatctactcttcagcaggagtcctcttttgagtgtctatgctgatatgtcagagacatgcaaagaatataaggatccaaatagatccatgctggaattggttttcgcacccgcggaggaatggatttcacgaagcgacactgatattattgaggcaacaatgcaagagctcgccaagcttttcccagatgaaatcgctgctgatgggagcaaggccaagatccttaaatatcatgtcgtcaaaactccaaggtcggtttataagacagtaccggattgtgagccttgtcggccgctgcaaagatcaccgatagagggtttctatttagctggtgattacacaaaacaaaaatatttggcttctatggaaggtgctgtcttatctgggaagctttgtgctcaggctattgtacaggattatgatctgctgagttctcgagcacaaagagaattggcggcgacaagcaatgtataaccctggattgctttgacatccgccattgattttcattcgagatctggattgggaatctgatcagtcatcgaaaaatgatcagctgtaaacaaaattatgggggttgcacattggtgttctcaagttcttgatttataaattcttcagaaagaagatttatttgtaatgatatatcaattgattgaaatatgtatagcttacttctagggaattatgtatgtgcaccagttaacttgattgaaat

SEQ ID NO: 17 - DNA, 2088 bp, Amaranthus rudis
tccatttttcttgttctttcagtttcacataccctctcatcaatcaatatccaaaactattacattttccaaactatttcaaacccaaaaatcaaaaacttttgattgaagaacaaactttgggggttttggaaaatgagtcattttggatatgcttgtgctactcaatccacatcaagatatgttcttttaggaaattcaaataaccccacttcaatttcatctattggaagtgattttttgggtcattctgtgagaaatttcagtgttagtaaagtttatgggggaaagcaaagaaatgggcactgccctttaaaggttgtttgtatagattatcctaggccagagcttgaaagtacatccaatttcttggaagccgcctacttatcttctacttttcggaattcgcctcgtcctcagaagccattagaagttgtaattgccggagcaggtttggctggtctatccacggcaaagtatttagctgatgcaggtcacaaacccatattgctggaagcacgagatgttttaggaggaaaggttgcagcgtggaaggatgaggatggtgactggtacgagactgggctacatatattctttggggcttatccaaatatccaaaatctatttggagaacttggtataaatgatcgattgcaatggaaggagcactctatgatttttgcaatgcctagcaagcctggtgaattcagtcgctttgattttcccgaagtcctgcctgcaccattaaatggcatatgggcaatcctaaggaataatgaaatgctaacctggccagaaaaaatcaagtttgccattggcttgttgcctgctatggctggcggacagtcatatgttgaagcacaagacggtttgagtgtccaagagtggatgagaaaacaaggagtacccgatcgtgtaactgatgaagtatttattgccatgtcaaaggcactgaacttcataaatcccgatgaactttcaatgcagtgcatcttgattgctctgaaccgattcctgcaggagaaacatggttctaagatggccttcctagacggaaaccctccagagaggctgtgcatgcctattgttgagcacattgagtcactaggtggtgaagttaaacttaactctcgtatacaaaagattcagttggatcagagtggaagcgtaagagttttttgctaactaatgggagggaaataagaggagatgcctatgtatttgctaccccagttgacattttgaagctgttgctacccgatacttggaaggaaatctcatacttcaaaaagcttgagaaattagtgggcgttcctgtgattaatgttcacatatggtttgacagaaaattaaagaatacgtatgaccatctactcttcagcaggagtcctcttttgagtgtctatgctgatatgtcagagacatgcaaagaatataaggatccaaatagatccatgctggaattggttttcgcacccgcggaggaatggatttcacgaagcgacactgatattattgaggcaacaatgcaagagctcgccaagcttttcccagatgaaatcgctgctgatgggagcaaggccaagatccttaaatatcatgtcgtcaaaactccaaggtcggtttataagacagtaccggattgtgagccttgtcggccgctgcaaagatcaccgatagagggtttctatttagctggtgattacacaaaacaaaaatatttggcttctatggaaggtgctgtcttatctgggaagctttgtgctcaggctattgtacaggattatgatctgctgagttctcgagcacaaagagaattggcggcgacaagcaatgtataaccctggattgctttgacatccgccattgattttcattcgagatctggattgggaatctgatcagtcatcgaaaaatgatcagctgtaaacaaaattatgggggttgcacattggtgttctcaagttcttgatttataaattcttcagaaagaagatttatttgtaatgatatatcaattgattgaaatatgtatagcttacttctagggaattatgtatgtgcaccagttaacttgattgaaat

SEQ ID NO: 18 - DNA, 4346 bp, Amaranthus rudis
aagtatgtacaagttgttaggtcatcactcaaaagtgatgtgtcacatttcatcatatgagcaaaaagtatttggttttagggataagcgactaaacaaatagatctatgtgaagattaacattttggaatattgaaactctatttgggaagtgattggagttggtagatagaatggaaaaacttaagatggactttatgtaggagatcacgtggattaatggagagaccaggccattcaaaacaaataagaaattatgcacattattgtatacatgcaaattaagaagagaaacaaacttggtatcatgatgggtgagtagtttgcctatgacgttgtagaggtgtgtggataaatgattagaacatgagctatgaatggaagagaaatattaatggttggtgcatatgcgcctcaagtgaaggcaaaggaagcaacaccaacaatgtcaaagtcttatttttaggtaatatgaaaaacaaaggaagcaatcaaaagaaatttctcaggcgagttgatgcaaattatcccaacattaagaaaattttgtatactagcgaacatgtagccatccatcacaaacacgtagtcctagatcttcatatgtgatcaacctcgtgcaagaatgaacttcaaggacaaagaaaaatcaaatgatagaacccaaaataagaggatacgaatttttcatttgattagacaaatgaggaagatccaaatccaacttggacaaagatgaagaatgttatcacccgcacaactaggggaattcaaggttaagcggattgtggtatgaggtaagaaagaatacaatataggggaattaggaagtaaaggaataagaaaaaaaagaatgatatatagctttaggaaaatctaggagtgaggagaatatagcaaaatatgaggaagttaaaaccaagacgaagcaagcgatatgtgagacaaagttaaaagataagagatatacaataagctgactcaagagaagaggataatgatctttgtagggtagcctaaaggagacaaatgattataaaagatactagttgaatgaactatgaagtgtgtcttggataaataacaaaataatattctccaagatgaatagatatacgataaatggaaggagtttttgacgagttgtgcaatggatgtcaaggggcacgatagtatacatctagaagaaattctgaaaaggtgcttttcttagaatgtaaattgtgagaaaaaggaagaaggcgattatcagtaaatcaattgtctttgttcacagaatgtgacaccaacatgttggatgggggagagaagttttctttgttaacgaatctttcggttatgtatggaagtatgttattttatgagacatcttgttcaagagctcatcattaatatagaggagtagaggtgttcaacgggatgggtcggggcaaaatttaaattggtcgggccggggcgggtcatgtctaagaggagcaacaacataaataataaaatataccatcgtatggacatatagtttagagatagattcaaaaatttttatatcttcaaatatgaatgtgagaaccgacttctcatactttattttacttacaggtttggctggtctatccacagcaaagtatttagctgatgcaggtcacaaacccatattgctggaagcacgagatgttttaggaggaaaggtgtgtgctatacttttcttgtagcttatgaaacaactccattgtgcttactctctaattagtttacttcagactatcagatgatttttgaactttttcctccctctgttcggctgtataattatatatgagaaacatgtttaaaaatgggtgcattaacatatatgaagttttttttatcaaggcgagattttgtcatccaaaaactttacttctgaatctgaacatgctgtatgatcctgtttctttatcttcatttgttgggattttcttgaggctcatgactactttcagttattatagttacccatcctgcataaatccgagtttacagttatagtaatgaaaataaataggctaattatattctcgtcggtcatcacagtatgatgaatcttgggctaatatgaagatgaggtaggaagaagaatttgtgttagtatgataatatgtgcccgccctaagcaagtgcaagccttgcctacgcctagggccccccaaaaattttagttttcaactagtgctaacgttcgaacttttctatatatatacaatagtttaggggcccaaataatctttcgccccgggcccctaaaaacctagggtcggctagtgccaagagaaatattgttgtgcaaagtttcttggtattttttcttgtgcttacaattcttgctccacagattgcagcgtggaaggatgaggatggtgactggtatgagactgggctacatatattctgtgagtgatcttttaattttctgcttagttgggtagttacccgtgtacttattatgtgcactctagtcatgtttattggaaaaatttactgcatatttatcagtccgatgtactgaacatcttcatattttcttgaagttggggcatatccaaatatccaaaatctatttggagaacttggtataaatgaccgattgcaatggaaggagcactctatgatttttgcaatgcctagcaaacccggtgaattcagtcgctttgattttcccgaagtcctgcctgcaccattaaatggttagtatatcggtgatggtttttgttggctgccaaattacttgatgcaatgcattaccttgtaaaatactccttccgtccccctgattttgccccatatactattttagtccgttcaattgaatttgcccattattatttttggacgtggttccacctataatacttgctataacctacaatttatttctctttcctacatcaaaaactatgattatcccgctaaaggacatggccccacttacaacacctcactaaaatacccactcacccgcttttcttaatcattgtaccatccgcccgaggagcaatctcggggggacagcggagtactactttagtgtttatgtgatgaaataggtacctgcatcaatatctcatgtcctgtggatacctagaaatgaatgaaaattatcattccgtattatcctgctttagaagcttgtaatatcactgaactttgttattctaatgtcttaacatgaaaagaatctgcatcttggtctgtttggactttggtactcctaaaccctaacgagtcgggctgatttatatctttgatgctttttgattgtgtttggcaggcatatgggcaatcctaaggaataatgaaatgctaacctggccagaaaaaatcaagtttgccattggcttgttgcctgctatggctggtggacagtcatatgttgaagcacaagatggtttgagtgtccaagagtggatgagaaagcaagtaggagcagactttcgtttcagattttcctcattttgttaatctcttctgattctgtcgattacgatgattctagctgtaaactttgactttgttgggacttcaatgctgaaattctgtttgcgcataaatgcagggagtacctgatcgtgtaactgatgaagtatttattgccatgtcaaaggcactgaacttcataaatcccgatgaactttcaatgcagtgcatcttgattgctctgaaccgattcctgcaggcatgagtgcctttcaatttctgctttaaattttttgttttgtacgacacttcttattgcttgtttttgtgactattctcgagtaaatttgggatataaaatgaccgtgctgttttccataaactgaccttgggtaatgtatatcaacaggagaaacatggttctaagatggccttccttgacggaaaccctccagagaggctgtgcatgcctattgttgagcacattgagtcactaggtggtgaagttaaacttaactctcgtatacaaaagattgagttggatcagagtggaagtgttaagagttttttgctaactaatgggagggaaataagaggagatgcctatgtatttgccaccccaggttttcttctctcccttttttgccataaggtctctatcaaactccgtaaaagctacatagtaaagaaaatgaagattccattgcagatatggacacaccgtatagcttaactagttttgatcttgtgcaaagcacttgtgtttccaaatttgttaatgggttataatttaaatagaatacttatgtttgtaatgtcaagcgttgagccaaagtgttataacaatgattatatagtgtagatcatcgtgtaaaattgcggtaaattttggt

SEQ ID NO: 19 - DNA, 3438 bp, Amaranthus rudis
ctcaaaattgttgaaaaatagcccaagaccgaccataattcttttttttttgatttgcgattcgcagggagattagcgaatcatgtgacactgtgtctgatataatttttgaatttcattgtcagttgacatcttgaagctgttactacctgatacttggaaggaaatctcatacttcaaaaagcttgagaaattagtgggcgttcctgtgattaatgttcacatatggttagttgattcttcattctatattaaatatactcgttagattttatacccattttccgtctcaggaaaaatactattcgctgcaatagagaacgataaaatgtggattatttaatgcgttgctttactccggggctaatggtataataacgcttcatgcaggtttgacagaaaattaaagaatacatatgaccatctactcttcagcaggttgtatttcgtttcttttatcatcctatttctctttcgtaactctcaaataatctcgttcctccccttccctccttcacttcaacacttgtttcaattcttcattttcggccgtagtcaaatttgatgaacatttgacaagagttgcattataactaatatgaacattggagaaggagcaacaatcatcatctatgaagtataagctaagattcctttgaagaaggtgaaagttaagtgcgaattttctttccattgggaaataagtcttttgattaacgtcttgaatagatgaaggatgcaagtttttggaatgaagagaaactttttatgtgatctagttgcgagtcgatggtgccttgaatttcttcaaaattaaacatttttgttaatgttcgctttattgttgcgctttcatgtccttttcctatagttgtatatggcttctcattctcaacttaggcttacctcaatgcctaaacctttacaaaacacatcatataagaatgagagtgttgaattgttgatatttacctctccatctcagcacaagtttcctttacttttgcacaaatcttaggaatgtgtaagttggtgaatagaaattactgttagggaatcttgtggggctcaaacaaatgagaaccgcaaataactttctaaatatagaaatgggtcactcgtggtgaaaagatccaatatgaaaattagacacttgtgctgagatggaggaagtatcatacttgtaaaaacataatacttgaggctgatgtgactttggtagtaactagtaaccatagtgcaaaaatgcggtaaccggttgcaatcacggtaacgacacgatgatgcggttatcataacgccaaatatcggccaaaagcgtgagatattccttctaacaacccaaaaacgcagtttttttacacctttatatcgcaagaaatatatgttcgttttttgaaaatctttagaacgcggccgttgcgatgtgatgctatgcggccttattttttcactatggtaatgacaaaacatttgcggatgcacacattggctaccgtttctgatccccttttcatttgtacacatcaatgtaacgtaattccccagctaattcgccttttgaattcggaattctctcaaaattgtggaaaaatagcccaactcctaccataattcgcttttttcgatttgcaattcgcggggagattagcggatcacatgacaatgatacaaatcctatggatttatgtatgttactgatttaaagacttcaaccccttagattaaatgttgaaaccatataagaatggaatttttaagattttttttatctaaattctttcctgaaccctattattaagtagctatggcctactagaggtggttacgattcatcatccttttcatcggcttcatgaatttgtacatatcttggacttctccagttctcctttaattttgtttatctttgttatttcaggagtcctcttttgagtgtctatgctgatatgtcggagacatgcaaggtgagcatattcccattttttttatttccgacttatatgttcgtgttctccgtttgtctctttttcgcgcatataatatcgaatgttagccactccccgttactccttctattctgctaacaccgggattttaactatgagggtcctcagaattaattataaaaattcgacaaaaacaaaaaaaagaaataaaattgatgggtcataacaattttacttgagatattcaacatttattttacaatttttcttaagaaattcagtacatctacactcccgagccactgcatgtgagcgccgcggcttgctgtttaagaaacctttcttagaagtgtcgactatatgcagtttcttccattcttacgatcatttacaggaatataaggatccaaatagatccatgctggaattggttttcgcacccgcggaggaatggatttcacgaagcgacaccgatattatcgaggcaacaatgaaagagcttgccaagcttttcccggatgaaatcgctgccgatgggagcaaggccaagatccttaaatatcatgtcgtcaaaactccaaggtgatcgataaacttgtgaaattaaaattggataatatcatgctaccgctagaaacagcattaatgttgtgcccgcgggctcttttataggtcggtttataagacagtgccggattgtgaaccttgtcggccgctgcaaagatcaccgatagagggtttctatttagctggtgattacacaaaacaaaaatatttggcttcaatggaaggtgctgttttatctgggaagctttgtgctcaggctattgtacaggtaatcaaagtttgattaaacaccgcgggcatgctgattagacttttcgtattttgattcgatccgaaattgacccaaaaccgaccggaaatcggtgggttataatttagaaaatatgacccgtaaccaaaaaatgactcaaacccaccgtagcccaaatccaatcgttttgacttgtttacctaattttgtcaacttttcttgttccacgtcgttagttttctgtcgggagtcgggacccactatctttctagtctgtttttgtatttcttttttctttgttgatgcttttattcgtttttacctagttatgtttatatatttatgtgttttatttatttatatgtttttgactaccgaggtatgatgattgtttctatgagcggatatactgagtatgatgatgatgatttattcttttttataaaaaaaaagttaaaggtctttttttgaaaatattttagtgatttttttgacctgatcaaatttcaattcgaaccaaaaataacccaagcgaaagtgactcaacccgaaacctaccctgatctaattgtaatgatagctttgaaatttttatcgttttagttaacaagttctgttgacgaatcttctttaaatttttacaagttaatataaatctcgaaagttcctata

SEQ ID NO: 20 - DNA, 2037 bp, Amaranthus rudis
cagggagattagcgaatcatgtgacactgtgtctgatataatttttgaatttcattgtcagttgacatcttgaagctgttactacctgatacttggaaggaaatctcatacttcaaaaagcttgagaaattagtgggcgttcctgtgattaatgttcacatatggttagttgattcttcattctatattaaatatactcgttagattttatacccattttccgtctcaggaaaaatactattcgctgcaatagagaacgataaaatgtggattatttaatgcgttgctttactccggggctaatggtataataacgcttcatgcaggtttgacagaaaattaaagaatacatatgaccatctactcttcagcaggttgtatttcgtttcttttatcatcctatttctctttcgtaactctcaaataatctcgttcctccccttccctccttcacttcaacacttgtttcaattcttcattttcggccgtagtcaaatttgatgaacatttgacaagagttgcattataactaatatgaacattggagaaggagcaacaatcatcatctatgaagtataagctaagattcctttgaagaaggtgaaagttaagtgcgaattttctttccattgggaaataagtcttttgattaacgtcttgaatagatgaaggatgcaagtttttggaatgaagagaaactttttatgtgatctagttgcgagtcgatggtgccttgaatttcttcaaaattaaacatttttgttaacgttcgctttattgttgcgctttcatgtccttttcctatagttgtatatggcttctcattctcaacttaggcttacctcaatgcctaaacctttacaaaacacatcatataagaatgagagtgttgaattgttgatatttacctctccatctcagcacaagtgtctcctttacttttgcactaaattttaggaacatgtaagttaatggatagaaattaaagttagggaatcttgtagggctcaaacaaatgagaactgcaaataactttctaaatatagaaatgggtcacttgtggtgacttgatcctatatgaaaatctgacacttgtgctgagatggagcaagtattatacttatgaaaacataatacttgaggtagatatacctttggtaggaactaggaaccatagtgcaaaaatgtggtaacggttgcaatcgtggtcacgacatgcgattatcataacgcctaatatgagccaaaagcgtgagatattccttgtaacggcccaaaacacggttttttttacacctttacatcgcgagaaatttcggtttgtttttttagaatctttaaaatacggccgatgctatgcgatgcgatgcggccttatttttgcactatggtagggacaaaacatttgcggatgatggatgcacacattggttaccatgtctggtccccttttcacttatacagatcccaagggcatatgtatgttactgattcaaagacttcaatctctaggattaaatgtagaaaccatataaaaatggatctttaaaatacttttatctttgttatttcaggagtcctcttttgagtgtctatgctgatatgtcggagacatgcaaggtgatcatattcccattcttttatttccgacttatatgttctagttctccatttgtctctttttcgcgcatataatttcgaatgttagccactccccattactccttctatttctgctaacaccgggattttaactatgagggtcctcagaattgattataaaaattcgacaaaaacaaaaaaaaagaaataaaattgatgggggccataacaattttactcaagatattcaacatttattttacaatttttcttaagaaattcagtacatctacactcccgagccactgcatatgtgcgccacggcttgctgtttaagaaacctttcttagaagtgtcgactatatgcagtttgttccattcttacgatcatttacaggaatataaggatcccaatagatccatgctggaattggt

SEQ ID NO: 21 - DNA, 1502 bp, Amaranthus rudis
tgaatgtgagaaccgacttctcatactttattttacttacaggtttggctggtctatccacagcaaagtatttagctgatgcaggtcacaaacccatattgctggaagcacgagatgttttaggaggaaaggtgtgtgctatacttttcttgtagcttatgaaacaactccattgtgcttactctctaattagtttacttcagactatcagatgatttttgaactttttcctccctctgttcggctgtataattatatatgagaaacatgtttaaaaatgggtgcattaacatatatgaagttttttttatcaaggcgagattttgtcatccaaaaactttacttctgaacatgctgtctgatcctgtttctttatcttcatttgttgggattttcttgaggttcatgactactttcagttattatagttacccatcctgcataaatctgagtttacagttatagtaatgaaaataaataggctaattatattctcgtcggtcatcacagtatgatgaatcttgggctaatatgaagatgaggtaggaagaagaatttgtgttagtatgataatatgtgcccgccctaagcaagtgcaagccttgcctacgcctagggccccccaaaaattttagttttcaactagtgctaacgttcgaacttttctatatatatacaatagtttaggggcccaaattagtttaggggcccaaataatcttaggggcccaaataatctttcgggcccaaataatctttcgccccgggcccctaaaaacctagggtcggctagtgccaagagaaatattgttgtgcaaagtttcttggtattttttcttgtgcttacaattcttgctccacagattgcagcgtggaaggatgaggatggtgactggtatgagactgggctacatatattctgtgagtgatcttttaattttctgcttagttgggtagttacccgtgtacttattatgtgcactctagtcatgtttattggaaaaatttactgcatatttatcagtccgatgtactgaacatcttcatattttcttgaagttggggcatatccaaatatccaaaatctatttggagaacttggtataaatgaccgattgcaatggaaggagcactctatgatttttgcaatgcctagcaaacccggtgaattcagtcgctttgattttcccgaagtcctgcctgcaccattaaatggttagtatatcggtgatggtttttgttggctgccaaattacttgatgcaatgcattaccttgtaaaatactccttccgtccccctgattttgccccatatactattttagtccgttcaattgaatttgcccattattatttttggacgtgattccacctataatacttgctataacctacaatttatttctctttcctacatcaaaaactataattatcccgctaaaggacatggccccacttacaacacctcactaaaatacccactcacccgcttttcttaatcat

SEQ ID NO: 22 - DNA, 680 bp, Amaranthus rudis
gatattatcgaggcaacaatgaaagagcttgccaagcttttcccggatgaaatcgctgccgatgggagcaaggccaagatccttaaatatcatgtcgtcaaaactccaaggtgatcgataaacttgtgaaattaaaattggataatttcatgctaccgctagaaacagcattaatgttgtacccgtgggctcttttataggtctgtttataagacagtgccggattgtgaaccttgtcggccgctgcaaagatcaccgatagagggtttctatttagctggtgattacacaaaacaaaaatatttggcttcaatggaaggtgctgttttatctgggaagctttgtgctcaggctattgtacaggtaatcaaagtttgattaaacaccgcgggcatgctgattagacttttcgtattttgattcgatccgaaattgacccaaaaccgaccggaaatcggtgggttataatttagaaaatatgacccgtaaccaaaaaatgactcaaacccaccgtagcccaaatccaatcgttttgacttgtttacctaattttgtcaacttttcttgttccacgtcgttagttttctgtcgggagtcgggacccactatctttctagtctgtttttgtatttcttttttctttgttgatgcttttattcgtttttacctagttatgttta

SEQ ID NO: 23 - DNA, 433 bp, Amaranthus rudis
agttcatattttgtatatatgcaggattatgatctgctgagttctcgagcacaaagagaattggcggcgacaagcaatgtataaccctggattgcttcgacatccgccatcgattttcattcgggatcatctgatcggtcatcgaataatgatcagctgtaaacacaaaattatgggggttgcatactggtgttcttcaagttcttaatgtataaattctccagaaagaagatttatttgtaatgatatatcaattaaatttatgttgtgatagaaatatgtatagcttacttctagggaaaattatgtttgtacaccagttaacttgattgaaatgtgaagaaagtatcaactttgtcacttgatttacttgtaagtataacataatatcaatttataccaatacatttatttcccttttctgtttaattat

SEQ ID NO: 24 - DNA, 210 bp, Amaranthus rudis
caattcgaaccaaaaataacccaagcgaaagtgactcaacccgaaacctaccctgatctaattgtaatgatagctttgaaatttttatcgttttagttaacaagttctgttgacgaatcttctttaaatttttacaagttaatataaatctcgaaagttcctataaacttattttacagattgtcaagattagttgtataaaagtgaagt

SEQ ID NO: 25 - DNA, 951 bp, Amaranthus spinosus
caatcctaaggaataatgaaatgctaacctggccagaaaaaatcaagtttgccattggcttgttgcctgctatggcgggcggacagtcatatgttgaagcacaagatggtttgagtgtccaagagtggatgagaaaacaaggagtacccgatcgtgtaactgatgaagtatttattgccatgtcaaaggcactgaacttcataaatcccgatgaactttcaatgcagtgcatcttgattgctctgaaccgattcctgcaggagaaacatggttctaagatggccttcctagacggaaaccctccagagaggctgtgcatgcctattgttaagcacattgagtcactaggtggtgaagttaaacttaattctcgtatacaaaagattcagttggatcagagtggaagcgtgaagagttttttgctaaataacgggagggaaatacgaggagatgcctatgtttttgccaccccagttgacattttgaagctgttactacccgatacttggaaggaaatctcatacttcaaaaagcttgagaaattagtgggcgttcctgtgattaatgttcacatatggtttgacagaaaattaaagaatacatatgaccatctactcttcagcaggagtcctcttttgagtgtctatgctgatatgtcggagacatgcaaggaatataaggatccaaatagatccatgctggaactggtttttgcacccgcggaggaatggatttctcgaagtgacactgatattatcgaggctacaatgacagagcttgccaagcttttcccggatgaaatcgctgccgatggaagcaaggccaagatcctcaaatatcatgtcgtcaaaactccaaggtcggtttataagactgtaccagattgtgaaccttgtcggccgctgcaaagatcaccaatagagggtttctatttagctggtgattactaca

SEQ ID NO: 26 - DNA, 568 bp, Amaranthus spinosus
ggatatgcttgtgccactcaatccacatcaagatatgttcttttaggaaattcaaataaccccacttcaatttcatctattggaagtgactttttgggtcattctgtaagaaatttcagtgttagtaaagtttatgggggaaagcaaagaaatgggcattgccctttaaaggttgtttgtatagattatcctaggccagagcttgaaagtacatcaaatttcttggaagccgcctacttatcttctacttttcggaattcgcctcgtcctcagaagccattagaagttgtaattgctggagcaggtttggctggtctatccacggcaaagtatttagctgatgcaggtcacaaacccatattgttggaagcacgagatgttttaggaggaaaggttgcagcgtggaaggatgaggatggtgactggtatgagactgggctacatatattctttggggcatatccaaatatccaaaatctatttggagaacttggtataaatgaccgactgcaatggaaggagcactctatgatttttgcaatgcctagcaagcccggtgaattcagtc

SEQ ID NO: 27 - DNA, 2070 bp, Amaranthus viridis
aaaacttttgattgaagaacaaactttggggttttggaaaatgagtcattttggatatgcttgtgctactcaatccacatcaagatatgttcttttgggaaattcaaataaccccacttcaatttcatctattggaagtgattttttgggtcattctgtgagaaatttcagtgttagtaaagtttatggggcaaagcaaagaaatgggcactgccctttaaaggttgtttgtatagattatcctaggcctgagcttgaaagtacatccaatttcttggaagccgcctacttatcttctacttttcggaattcgcctcgtcctcagaagccattagaagttgtaattgctggagcaggtttggctggtctatccacggcaaagtatttagctgatgcaggtcacaaacccatattgttggaagcacgagatgttttaggaggaaaggttgcagcgtggaaggatgaggatggtgactggtatgagactgggctacatatattctttggggcatatccaaatatccaaaatctatttggagaacttggtataaatgaccgactgcaatggaaggagcactctatgatttttgcaatgcctagcaagcccggtgaattcagtcgctttgattttccagaaatcctgcctgcaccattaaatggcatatgggcaatcctaaggaataatgaaatgctaacctggccagaaaaaatcaagtttgccattggcttgttgcctgctatggcgggcggacagtcatatgttgaagcacaagatggtttgagtgtccaagagtggatgagaaaacaaggagtacctgatcgtgtaactgatgaagtgtttattgccatgtcaaaggcactgaacttcataaatcccgatgaactttcaatgcagtgcatcttgattgctctgaaccgattcctgcaggagaaacatggttctaagatggccttcctagacggaaaccctccagagaggctgtgcatgcctattgttaagcacattgagtcactaggtggtgaagttaaacttaattctcgtatacaaaagattcagttggatcagagtggaagcgtgaagagttttttgctaaataacgggagggaaatacgaggagatgcctatgtttttgccaccccagttgacattttgaagctgttactacccgatacttggaaggaaatctcatacttcaaaaagcttgagaaattagtgggcgttcctgtgattaatgttcacatatggtttgacagaaaattaaagaatacatatgaccatctactcttcagcaggagtcctcttttgagtgtctacgctgatatgtcggagacatgcaaggaatataaggatcctaatagatccatgctggaactggtttttgcacccgcggaggaatggatttcacgaagcgacactgatattatcgaggcaacaatgaaagagcttgccaagcttttcccggatgaaatcgctgccgatggaagcaaggccaagatccttaagtatcatgttgtgaaaacaccaaggtcggtttataagactgtaccggattgtgaaccttgtcggccgctgcaaagatcaccaatagagggtttctatttagctggtgattacacaaaacaaaaatatttggcttctatggaaggtgctgtcttatctgggaagctttgtgcacaggctatcgtacaggattatgatctgctgagttctcgagcacaaagagaattggcggcgacaagcaatgtataaccctaaattgcttcgacatccgccatcgactttcattcgagatctggattgggaatctgatcatcgaataatgatcagctgtaaagaaaattgtgggggttgcatactggtgctgttcaagttcttgatgtacaaattctcctgaaagaagatttatttgtaatgatatatcaattgatagaaatatgtatagcttacttctagggaattatgtatgtgcaccatttgtaacttgattgaaatgtaagtatcaacttggtctcttgattgaaatgtaagtatcaacataatacaaatttataccaatacatttatttccc

SEQ ID NO: 28 - DNA, 1388 bp, Ambrosia artemisiifolia
atccatacgctcaggtaatctatcttcacttaatccttagggtttatatttcctgcttaagaaggtgagtttatgttacaatgctttgctttattttaactttatgtgttcgatttcatgttaaatcttcacatgttaattgattaggattatttttattcttttttatttgaattagcgttaaaatcatttatggattttttatttgaaccatttattgtgtggacttccatttctataattatcattcaaatagtaagaaaaaggaatgaaaagtctagctttattttgatatatatattttttatcatttctgtagggcataccagatcgagttactactgaggtgtttattgccatgtcaaaggcattaaacttcatcaatccagatgaactttcaatgcagtgcattctcattgctctcaaccgctttcttcaggtaaactcatttattataccttgacgcttattgatttaagtattttggaataaactaatatcactacaatttagtttcatttatgttttctgtatataaaagatgagtcataaatcattattgttgttgtctaaagacactgcaactcctgactgtattttcagttattgactggtataaaatgaatcaacaggaaaagcatggctctaagatggcatttttagatggcagcccacctgaaagactttgcatgccaattgttgaccatattgaatcactaggtggccaagtcagacttaattcgcggatacaaaagatcgagttaaacaaagatgggactgttaaaaactttttactgaatgatgggactgtcatcaaaggtgatgcttatgtgtttgctactccaggtatgttaattcaaaccactatttggctttgaactttgaagtctccacatatatctctctctggagtgcacaagctttattgtctgttttgtatcaagcagttgacattctgaagcttcttttgcctgaagattggaaaccggttccatacttcaaaaagttggaaaaattagttggtgttccagttataaacgttcatatatggttagatggaccctttcaatataatgctaatccttataacgatagtagttatgccctttcacttgttttattgttaccccaattttctaggtttgtactaggaagctcaaaaacacttatgatcacctacttttcagcaggtcacctcttatttcttgcgtaaacatttaattattttctcacaaagaatgttggcttttttactttcggcatgtgacctcttatcattgctgctactgttgatttatatttttcttccatcttttccaggagccctcttcttagtgtatatgctgacatgtctgttacatgtaaggtatacttgtatggcaattgac

SEQ ID NO: 29 - DNA, 268 bp, Ambrosia artemisiifolia
caattggactcttgcctgccatgatgggtggacaggctgttgaggctcaagatggacttagtgtccaagattggatgagaaagcaagtatgtaatcatttaacttactttctaccctgctataatcatttaattcaggtaaaacagactgcatatatatatattttttttatcatttctgtagggcataccagatcgagttactactgaggtgtttattgccatgtcaaaggcattaaacttcatcaatccagatgaactttcaatgc

SEQ ID NO: 30 - DNA, 2016 bp, Ambrosia trifida
attcgaaacaagggccgaccaagttccaacaacgaaacaagccaaaaaccgttccaaccaactactactacttcatcttcttaatcatcatcatcttctcctcctcttttaaattaataaaaattagagcagcagcagcagcagcagcagcaattgagttgatcgagtctcttaggtcatgtctctggttggaaattctgtagtaacgagtcatgtattgtcgtttagtcaggcgggtgctcatcgactgaaattcccggctgtccgattaagaaccaacaacactgtctactgccctttcaaggtggtctgcgtcgactatccaagaccagaccttgacaacacttctaacttcttagaggctgcctacttgtcttctaccttccgagcttcccctcgtccagctaagcccttaaacgttgttattgctggtgcaggtttggctggtctatccactgctaagtatttggctgatgccggtcataagccccttttgcttgaagcaagagacgttcttggtggaaaggttgcggcttggaaagatgatgacggagattggtacgagacaggcttacacattttctttggagcttacccaaatgtacagaacctctttggagagttagggattaatgatagactacaatggaaggagcattctatgatttttgcaatgccaaacaagcctggtgaatttagtcgcttcgacttcccagatgttttgcctgcaccactaaatggaatttgggctatcttgaggaacaatgaaatgttgacatggcccgagaaagtcaaattcgcaatcggactcttgcctgcaatgttgggtggacaagcttatgttgaggctcaagatggacttagtgttcaagattggatgagaaagcaaggcataccagatcgagttactactgaggtttttattgccatgtcaaaggcattaaacttcatcaatccagatgaactttcaatgcaatgcattctcattgctctgaaccgctttcttcaggaaaagcatggctctaagatggcatttttagatggcagcccacctgaaagactttgcatgccaattgttgaccatattgaatcactaggtggccaagtcagacttaattcacggatacaaaagattgagttaaacaaagatggaactgttaaaaactttttactcaatgacgggactatcatcaaaggtgatgcttatgtgtttgctactccagttgacattctgaagcttcttttgcctgaagattggaaaccggttccatacttcaaaaagttggaaaaattagttggtgttccagttataaacgttcatatatggtttgacaggaagctcaaaaacacttatgatcacctacttttcagcagaagccctcttcttagtgtatatgctgacatgtctgttacatgtaaggaatattatgatccaaatcggtcaatgttggaattggtttttgcacccgcagaagaatggattgcacgcagcgactctgacattattgatgccaccatgagtgaactttcaagactctttcctgatgaaattgcagcagatgggagcaaagcaaaaatattgaaatatcatgtagtaaaaacaccaaggtcggtttataaaactgtgccagactgtgaaccttgccgtcccttgcaaagatctccaatagaaggattttatttagctggtgattacacgaaacaaaagtatttggcttcaatggagggtgctgttttgtcaggaaaattttgtgcccaggctattgtacaggattacgagttgcttgctgcgaggggggaggtgatggctgaagcaagcctggtctaagatgacgtggcaagttgaaaattgataaaacacccatccatccatagaacttatcttgtatctgttactttatacatgcattgattaatcagtatttgaaatagcaattgcttgtgaaaaagtttgggtgatgaacacagttttgacttgtttatagtttttttgctaataactagtaaagatgatcg

SEQ ID NO: 31 - DNA, 2399 bp, Ambrosia trifida
acttgtatggcaattgacatgttaactacattaccttttttaccccacagacgaaagactgttaaacaagttgctcatattattcaggaatattatgatccaaatcggtcaatgttggaattggtttttgcacccgcagaagaatggattgcacgcagcgactctgacattattgatgccaccatgagtgaactttcaagactctttcctgatgaaattgcagcagatgggagcaaagcaaaaatattgaaatatcatgtagtaaaaacaccaaggctagtattcacatgtgcaaaccgaagacaaatttgtttattctgatgaagtattaattaattattgggttgtggtgcttcaggtcggtttataaactgtgccagactgtgaaccttgccgtcccttgcaaagatctccaatagaaggattttatttagctggtgattacacgaacaaaagtatttggcttcaatggagggtgctgttttgtcaggaaaattttgtgcccaggctattgtacaggtaataaataattgagtaagcataaaacacaaacaaggcgagattttgtgtgatctcatgcatcatcttgttatgttacacaggattacgagttgcttgctgcgaggggggaggtgatggctgaagcaagcctggtctaagatgacgtggcaagttgaaaagtaaaaaagccaacattttttatgagaaaataattaactgttttgcaagaagtaagagatgacgacctgctgaaaagtaggtgatcataagtgtttttgagcttcctgtcaaacctgaaaattggctgaattattattaccttataaggaaggattagcattatattgaaagggtcggtccatctaaccaaccatatatgaacgtttataactggaacaccaactaatttttccaactttttgaagtatggaaccggtttccaatcttcaggcaaaagaagcttcagaatgtcaactgcttgatacaacacagccagtaaagtaaagcttgtggcccccagagagaaatatgtggagacttcagccaaatggcggtttaattaacatacctggagtagcaaacacataagcatcacctttgatgatagtcccgtcattgagtaaaaagtttttaacagttccatctttgtttaactcaatcttttgtatccgtgaattaagtctgacttggccacctagtgattcaatatggtcaacaattggcatgcaaagtctttcaggtgggctgccatctaaaaatgccatcttagagccatgcttttcctattgattcattgtacagcggtcaataattgaaagaaaatacagtcgcgagttgcagtgtctttagacaacaacaataatgagccatctttttcttttatatacataaaacataaatgaaactaaactcttgtgacattaatttattccaaattacttaatcagtagtaagcttgaagataataataataataataatgagtttacctgaagaaagcggttcagagcaatgagaatgcattgcattgaaagttcatctggattgatgaagtttaatgcctttgacatggcaataaaacctcagtagtaactcgatctggtatgccctacagaaatgataaaaatatatatatatgcagctgttttacttaaaaatcaacttatagcaacttaaatgactacatacttgctttctcatccaatcttgaacactaagtccatcttgagcctcaacataagcttgtccacccaacattgcaggcaagagtccgattgcgaatttgactttctcgggccatgtcaacatttcattgttcctcaagatagcccaaattcctataataggatgcaaattagaaagataagattcatagtagtggtcggtctgaggtagttgtagttagtagataacttgccatttagtggtgcaggcaaaacatctgggaagtcgaagcgactaaattcaccaggcttgtttggcattgcaaaaatcatagaatgctccttccattgtagtctatcattaatccctaactctccaaagaggttctgtacatttgggtaagctccaactgtgaagcaaagggaagagttagttaaagcagctgattttccatccattattagttagttagttgagtaaagtaaaaacttacagaaaatgtgtaagcctgtctcgtaccaatctccgtcatcatctttccaagccgcaacctttccaccaagaacgtctcttgcttcaagcaaaaggggcttatgaccggcatcagccaaatacttagcagtggatagaccagccaaacctgcataataataataataataagcaaatgaaagtgaggagaaagaaagaaagaaagaaaaggggtgggtacctgcgccagcaataacaacgtt

SEQ ID NO: 32 - DNA, 2377 bp, Ambrosia trifida
aaatattaatggttggtgcatatgcgcctcgagtgaaggcaaaggaagcaacaccaacaatgtcaaagtcttatttccaggtaatatgaaaagcaaaggaagcaatcaaaagaaatttcttggacgagctgatgcaaattatcccaacattaaaaaaattttgtatactgccgaacatgtagccatccatcacaaacacgtagtcctagatcttcatatgtgatcaacctcgtgcaagaataaacttcaaagacaaagaaaaatcaaatgatagaacccaaaataagaggatacgaatttttcatttgattagacaaatgaggaagatccaaatccaacttggacaaagatgaagaatgttatcacccgcacaactaggggaattcaaggttaagcggattgtggtatgaggtaagaaagaatacaatataggggaattaggaagtaaaggaataagaaaaaaaagaatgatatatagctttaggaaaatctaggagtgaggagaatatagcaaaatatgaggaagttaaaaccaagacgaagcaagcgatatgtgagacaaagttaaaagagtattaagagatatacaataagctgactcaagagaagaggataatgatctttgtaggatagcctgaaggagacaaatgattataaaagatactagttgaatgaactatgaagtgtgtcttggataaataacaaaataatattctccaagatgaatagatatacgataaatggaaggagttttttgacgagttgtgcaatggatgtcaaggggcacgatagaatacatcttgaaggaattctgaaaaggtgcttttctaggaatgtaaattgtgagaaaaggaagaaggcgatcatcggtaaatcaattgtctttgctcacaaaatgtgacaccaacatgttggatgggggagagaagttttcaatgttaactactctttcggttatgtacgtaagtatgtttttttatgaggcatcttgttcaagagctcatcattaatatagaggagcaaaaacttacagataccatcttatggaccaagcatatattgttcacaaatagattcaaaaccttttatatcttcaaatatgaatgtgagaaatgacttctcttactttttttacttccaggtttggctggtctatccacggcaaagtatttagctgatgcaggtcataagccccttttgcttgaagcaagagacgttcttggtggaaaggttgcggcttggaaagatgatgacggagattggtacgagacaggcttacacattttctgtaagtttttactttactcaactaactaactaataatggatggaaaatcagctgctttaactaactctttcctttgcttcacagttggagcttacccaaatgtacagaacctctttggagagttagggattaatgatagactacaatggaaggagcattctatgatttttgcaatgccaaacaagcctggtgaatttagtcgcttcgacttcccagatgttttgcctgcaccactaaatggcaagttatctactaactacaactacctcagaccgaccgaccactactatgaatcttatctttctaatttgcatcctattataggaatttgggctatcttgaggaacaatgaaatgttgacatggcccgagaaagtcaaattcgcaatcggactcttgcctgcaatgttgggtggacaagcttatgttgaggctcaagatggacttagtgttcaagattggatgagaaagcaagtatgtagtcatttaagtttttttatcatttctgtagggcataccagatcgagttactactgaggtttttattgccatgtcaaaggcattaaacttcatcaatccagatgaactttcaatgcaatgcattctcattgctctgaaccgctttcttcaggtaaacattttctttcaattattgaccgctgtacaatgaatcaataggaaaagcatggctctaagatggcatttttagatggcagcccacctgaaagactttgcatgccaattgttgaccatattgaatcactaggtggccaagtcagacttaattcacggatacaaaagattgagttaaacaaagatggaactgttaaaaactttttactcaatgacgggactatcatcaaaggtgatgcttatgtgtttgctactccaggtatgttaattaaaccgccatttgcctgaagtctccacatatttctctctgggggccacaagctttactttactggctgttttgtatcaagcagttgacattctgaagcttcttttgcctgaagattggaaaccggttccatacttcaaaaagttggaaaaattagttggtgttccagttataaacgttcatatatgg

SEQ ID NO: 33 - DNA, 2057 bp, Ambrosia trifida
gtcatctcttacttcttgcaaaacagttaattattttctcataaaaaatgttggcttttttacttttcaacatgtcacctcttatcattgcattgctgctactgtcgatttatatttttcttccatcttttccagaagccctcttcttagtgtatatgctgacatgtctgttacatgtaaggtaatacttgtatggcaattgacatgttaactacattaccttttttaacccacagacgaaagactgttaaacaagttgctcatattattcaggaatattatgatccaaatcggtcaatgttggaattggtttttgcacccgcagaagaatggattgcacgcagtgactctgaaattattgatgccaccatgagtgaacttgccaagactctttcctgatgaaattgcagcagatgggagcaaagcaaaaatattgaaatatcatgtcgtcaaaactccaaggtgatcgataaacttgtgaaattaaaatcggataatatcatgctactgctagaaacagcattaatgttgtgcccgcgggctcttttataggtcggtttataagacagtgccggattgtgaaccttgtcggccgctgcaaagatcaccgatagagggtttctatttagctggtgattacacaaaacaaaaatatttggcttcaatggaaggtgctgttttatctgggaagctttgtgctcaggctattgtacaggtaataaataattgagtaagcataaaacacaaacaaggcgagattttgtgtgatctcatgcatcatcttgttatgttacacaggattacgagttgcttgctgcgaggggggaggtgatggctgaagcaagcctggtctaagatgacgtggcaagttgaaaattgataaaaacacccatccatccatagaacttatcttgtatctgttactttatacatgcattgattaatcagtatttgaaatagcaattgcttgtgaaaaagtttgggtgatgaacacagttttgacttgtttatagtttttttgctaataactagtaaagatgatcgatttaatgagagaagatctactatggtatgacggctttaataaacaacttcagtcctaaccataactaggtatcaaatttatgaataaacatcacagctcacagctaaacattcagctttgatatctatatgaaatctcagatgctttctaattaacttctccaggaccaattggattctttaagtttgtaggagtgtagttgagttggcggttcaaattgatatcccaaccatattagcaggtccacatgtatttatttatatgtttcattttccattcaaacagttgctgttgaaggtactagttaagtctgctgttaaacaagtagattgcagataactttgagcatcatcaagttatatataccgaataggatgcttttgaaagacatgagccggaaaaaacgctatgaggttgatcatacattttgtacgcacgtaaaacacaaatacaaggcaaaataatagtgtctacagacgactgactgattacaggtacactaaccacatctgtatttcaaggctgtgtgtttttatgtttgcccttgtatccgtaaattacggagccaattgaccacttccttaatcgttggccgcttggcggggttaacatttatacacatgcaggcaacatcccttcttgaagcccattgcccgggtcaaatacttgatactgtttcccttcggctctcagttgaagcatccacacaaccagttctcatgaatgcttggacctgagcctaaatatctctatcttgtaggtagctctagcatcacaatcccaaaactattcattatccccttttaaggtggctatcaatagactggctgtactctgctgggatataccacccattagtggtgacataggtattatagtgttagatcagtctagacaacccaaaattggcaaaactacgcttcaaactgtgatgtatctgatacttagtagctactaactatctggtcaggaaacggacggtttgcggtgtcaaggagccaaaggtatcaaa

SEQ ID NO: 34 - DNA, 1401 bp, Ambrosia trifida
tgtttgtatcaagcagttgacattctgaagcttcttttgcctgaagattggaaaccggttccatacttcaaaaagttggaaaaattagttggtgttccagttataaacgttcatatatggttggttagatggaccgaccctttcaatataatgctaatccttccttataaggtaataataattcagccaattttcaggtttgacaggaagctcaaaaacacttatgatcacctacttttcagcaggtcgtcatctcttacttcttgcaaaacagttaattattttctcataaaaaatgttggcttttttacttttcaacatgtcacctcttatcattgcattgctgctactgtcgatttatatttttcttccatcttttccagaagccctcttcttagtgtatatgctgacatgtctgttacatgtaaggtaatacttgtatggcaattgacatgttaactacattaccttttttaccccacagacgaaagactgttaaacaagttgctcatattattcaggaatattatgatccaaatcggtcaatgttggaattggtttttgcacccgcagaagaatggattgcacgcagcgactctgacattattgatgccaccatgagtgaactttcaagactctttcctgatgaaattgcagcagatgggagcaaagcaaaaatattgaaatatcatgtagtaaaaacaccaaggctagtattcacatgtgcaaaccgaagacaaatttgtttattctgatgaagtattaattaattattgggttgtggtgcttcaggtcggtttataaaactgtgccagactgtgaaccttgccgtcccttgcaaagatctccaatagaaggattttatttagctggtgattacacgaaacaaaagtatttggcttcaatggagggtgctgttttgtcaggaaaattttgtgcccaggctattgtacaggtaataaataattgagtaagcataaaacacaaacaaggcgagattttgtgtgatctcatgcatcatcttgttatgttacacaggattacgagttgcttgctgcgaggggggaggtgatggctgaagcaagcctggtctaagatgacgtggcaagttgaaaattgataaaaacacccatccatccatagaacttatcttgtatctgttactttatacatgcattgattaatcagtatttgaaatagcaattgcttgtgaaaaagtttgggtgatgaacacagttttgacttgtttatagtttttttgctaataactagtaaagatgatcgatttaatgagagaagatctactatggtatgacggctttaataaacaacttcagtcctaaccataactaggtatcaaatttatgaataaacatcacagctcacagctaaacattcagc

SEQ ID NO: 35 - DNA, 649 bp, Ambrosia trifida
tgccaattgttgaccatattgaatcactaggtggcgaagtcagacttaattcacagatacaaaagattgagttaaacaaagatgggactgttaaaaactttttactcaatgatgggactatcatcaaaggtgatgcttatgtgtttgctactccaggtatgttaattaaaccaccatttggctttgaactttgaagtctccacatatttctctctggggtccataagctttgctggctgtttgtatcaagcagttgacattctgaagcttcttttgcctgaaaattggaaaccggttccatacttcaaaaagttggaaaaattagttggtttttcagttataaatgttcatatatggttagatggaccctttcaatataatgctaatccttataagataataataattcagccctttcacattttttattgtgaacccaattttaagataatgaattactactctttcgcttgtgtacaaccattccagatgatgtttttgaggattatgaatcacaagcaatgtatgcatctactgatataatgtggttaatcaaggtaatgtcaactttctccaaatttcattgtggctaataagtcaaaatgggttcgcgctggttgagtcaaattaaaccaggttggattaagtc

SEQ ID NO: 36 - DNA, 631 bp, Ambrosia trifida
tttcttttctgtctttctcctcactttcttttgcttattattattattattatgcaggtttggctggtctatccactgctaagtatttggctgatgccggtcataagccccttttgcttgaagcaagagacgttcttggtggaaaggttgcggcttggaaagatgatgacggagattggtacgagacaggcttacacattttctgtaagtttttactttactcaactaactaactaataatggatggaaaatcagctgctttaactaactcttccctttgcttcacagttggagcttacccaaatgtacagaacctctttggagagttagggattaatgatagactacaatggaaggagcattctatgatttttgcaatgccaaacaagcctggtgaatttagtcgcttcgacttcccagatgttttgcctgcaccactaaatggcaagtatgctattatttactaactacctcatgctattacttactatgaatcttatcttcattctaatttgcatgttattataggaatttgggctatcttgaggaacaatgaaatgttgacatggcccgagaaagtcaaattcgcaatcggactcttgcctgcaatgttgggtggacaagcttatgt

SEQ ID NO: 37 - DNA, 540 bp, Ambrosia trifida
caacgaaacaagccaaaaaccgttccaaccaactactactacttcatcttcttaatcatcatcatcttctcctcttttaaattaaataaaaattgagcagcagcagcagcagcaattgagttgatcgagtctcttaggtcatgtctctggttggaaattctgtagtaacgagtcatgtattgtcgtttagtcaggcgggtgctcatcgactgaaattcccggctgtccgattaagaaccaacaacactgtctactgccctttcaaggttattttcttcttcttcttctgtctgtaattctgtatatataatatggtaatggtaatttcccccctcccctcccctctcttattgcttattctattctatttatgtgaaattaatatataataataataataggtggtctgcgtcgactatccaagaccagaccttgacaacacttctaacttcttagaggctgcctacttgtcttctaccttccgagcttcccctcgtccagctaagcccttaaacgttgttattgctggtgcaggtaccc

SEQ ID NO: 38 - DNA, 2432 bp, Conyza canadensis
cggagagacttgcctaacacacgaactccaagtacaaattcatcaccatataaaagtgtcacatatgcttcttcttcttcttttgatgatccagctggagctccttccacaattatctcatttaataataataataataatcctactaacccaaaccctaatctcctcaatttcattttttaatctaatagtctgattattaagagattataaggagattagaaatgaggtttttgttatacaataagatattattgtatttttaatcttttttaagttttttggaattattttgggggtttatgatagaaattgtggcaactgaatttttggtgggttttttgagaatttgattttaagggctggtgtttgtctgatcatctgcagcgagctgatagtattattattatgtctctttttggaaatgtctctgccattaacctaactggaaactgtctgctatcaatcactagttccagagatgttttgtcatttcggcacggtgatactatgggttatcgcttgcaatcccccccttcttttattaccaaaactaacaaaaatgtctcccctttgaaggtagtttgtgtcgactatccaagaccagacctcgataacacctctaatttcttggaagctgcttatttgtcttctaccttccgagcttctccacgcccacctaagccattgaaggttgtaattgctggtgcaggtctcgctggtttatcaactgcaaagtacttggctgatgccggtcacaagccaattttgctagaagcaagagatgttcttggtggaaaggtagctgcctggaaagatgatgatggagattggtacgagactggtttacacatattttttggagcttacccgaatatacagaatctgtttggagagttaggcattaatgatagattgcagtggaaggagcattcaatgatatttgcgatgccaaacaaacctggagaatttagtcggtttgatttcccagatgttctgccggcaccattgaatggaatttgggctatcttgaggaacaatgaaatgctgacatggcctgagaaagtaaaatttgctatcgggctcttgcctgcaatgttaggtggacaggcttatgttgaggcacaagatggtctgagtgttcaagactggatgagacaacggggcataccagatcgagttactacagaggtgtttattgccatgtcaaaggcattaaacttcatcaatccagatgaactttcaatgcaatgtattctgattgctctgaaccgatttcttcaggagaagcatggttctaagatggcatttttagatggcagcccacctgaaagactttgcatgccaattgttgagcatattgagtcactaggtggccaagtcaggcttaattcacgaatacaaaagatcgagttgaacaaagatggaacagttaggaactttttactttatgatggaaatattattgaaggtgatgcttatgtatttgctactccagttgatattctgaagcttctgttgcctgaagattggaaagcaattccttacttcaagaagttggataaattagttggtgtcccagttataaacgttcatatatggtttgacaggaaactcaaaaacacctatgatcacctactcttcagcaggagccctcttctcagtgtatatgccgacatgtctgtaacatgcaaggaatactatgatcctaaccggtccatgttagagttggtttttgcacctgcagaagaatggatttcacgcagtgactctgatattattgacgctacgatgagtgaactttcaagactatttccggatgaaattgcagcagatcagagcaaagcaaaaatattgaaataccatgtagttaaaaccccaaggtcagtttacaaaactgtacctgactgtgaaccttgccgtccattacaaagatctccattagagggattctatttagctggcgactacacgaaacaaaagtatctggcttcaatggagggtgctgttctatcaggaaaattttgcgcccaagcgattgtaaaggattatgagttgcttgctgccaggagggaagtggttgctgaggcaagccttgtctaactgtatagatgcaagataacttggtaagttaaaaatcagttgaagacaagagcacgtggttctttgcatatttgactttttatggtccttggctgaagtggtaggcttaaggaggtggcagaatttctgggaggagcttttacaagttcagaagaagctaaacataaatacacccatagcaattcattgttctaactgaaacttatttcatatttgtcaaagaaaaaaatacatattcctgttatgtacatagttggttattttcccttgttttatacgtcatgtgtggcatcgaatctattgattatctatacgtattatatgtggca

SEQ ID NO: 39 - DNA, 2206 bp, Conyza canadensis
acaacatcccttgtttcctcttcttcttgttttctttttctttctttttgctaaaaaactcacacacgcagaagaagaagacgaagacaaagtcagagagttgagtttggactgattgattgatttgttattaagggctggtgtttgtctgatcatctgcagcgagctgatagtattattattatgtctctttttggaaatgtctctgccattaacctaactggaaactgtctgctatcaatcactagttccagagatgttttgtcatttcggcacggtgatactatgggttatcgcttgcaatcccccccttcttttattaccaaaactaacaaaaatgtctcccctttgaaggtagtttgtgtcgactatccaagaccagacctcgataacacctctaatttcttggaagctgcttatttgtcttctaccttccgagcttctccacgcccacctaagccattgaaggttgtaattgctggtgcaggtctcgctggtttatcaactgcaaagtacttggctgatgccggtcacaagccaattttgctagaagcaagagatgttcttggtggaaaggtagctgcctggaaagatgatgatggagattggtacgagactggtttacacatattttttggagcttacccgaatatacagaatctgtttggagagttaggcattaatgatagattgcagtggaaggagcattcaatgatatttgcgatgccaaacaaacctggagaatttagtcggtttgatttcccagatgttctgccggcaccattgaatggaatttgggctatcttgaggaacaatgaaatgctgacatggcctgagaaagtaaaatttgctatcgggctcttgcctgcaatgttaggtggacaggcttatgttgaggcacaagatggtctgagtgttcaagactggatgagacaacggggcataccagatcgagttactacagaggtgtttattgccatgtcaaaggcattaaacttcatcaatccagatgaactttcaatgcaatgtattctgattgctctgaaccgatttcttcaggagaagcatggttctaagatggcatttttagatggcagcccacctgaaagactttgcatgccaattgttgagcatattgagtcactaggtggccaagtcaggcttaattcacgaatacaaaagatcgagttgaacaaagatggaacagttaggaactttttactttatgatggaaatattattgaaggtgatgcttatgtatttgctactccagttgatattctgaagcttctgttgcctgaagattggaaagcaattccttacttcaagaagttggataaattagttggtgtcccagttataaacgttcatatatggtttgacaggaaactcaaaaacacctatgatcacctactcttcagcaggagccctcttctcagtgtatatgccgacatgtctgtaacatgcaaggaatactatgatcctaaccggtccatgttagagttggtttttgcacctgcagaagaatggatttcacgcagtgactctgatattattgacgctacgatgagtgaactttcaagactatttccggatgaaattgcagcagatcagagcaaagcaaaaatattgaaataccatgtagttaaaaccccaaggtcagtttacaaaactgtacctgactgtgaaccttgccgtccattacaaagatctccattagagggattctatttagctggcgactacacgaaacaaaagtatctggcttcaatggagggtgctgttctatcaggaaaattttgcgcccaagcgattgtaaaggattatgagttgcttgctgccaggagggaagtggttgctgaggcaagccttgtctaactgtatagatgcaagataacttggtaagttaaaaatcagttgaagacaagagcacgtggttctttgcatatttgactttttatggtccttggctgaagtggtaggcttaaggaggtggcagaatttctgggaggagcttttacaagttcagaagaagctaaacataaatacacccatagcaattcattgttctaactgaaacttatttcatatttgtcaaagaaaaaatacatattcctgttatgtacatagttggttattttcccttgttttatacgtcatgtgtggcatcgaatctattgattatctatacgtattatatgtggca

SEQ ID NO: 40 - DNA, 15961 bp, Conyza canadensis
tagtgtaatttaattattaatattaagagaatagtgtatgtgaaaatcttttaaaggtttgtaggcttgtagccttgtaggtgaaaatattacataggagggcattttagacatttccccatgtaactttcaacatggagggtattttctttaatatagagtataaataatggagatattttaaaaaaataaaggactgatagtgtaatttaattattaatattaagagaatagtgtatgtgaaaatgttttaaagggttgtaggtttgtagccttgtaggtgaaaatattacataggaggacattttagacatttaccccatgtaactttcaacatggggggtattttctttaatatagagtataaatatagataaataatatatattttgtaaattttttaaactaataaattattttaaaataataatttttataaaatatattttatttgataaataataactctaaattacacagatggtacctataatttgtattatattacatgtttcatacctcacatacaagacacgttggctacttaatgatacaactaacgaccgtcagcgtgaggtatcttctaagtgtaaaattgtaaacatgatataattgacgtaatttaaatctaacaggtatgaaattaataatttcgaccaaaccaaaggtacttaattcactcttaatatactgtatctaatactactcgtggtagtattatgtagattcctagcaatggacgacaatattccaacaacataagaagccaaaacccacttccttccttttttttttttgttgttgaataatttaatcagtttttaggaacgaacaacctcctccatttccagataaattattattcagccaagcaaaaaacacaacatcccttgtttcctcttcttcttgttttctttttctttctttttgctaaaaaactcacacacgcagaagaagaagacgaagacaaagtcagagagttgagtttggactgattgattgatttgttattaaggtaaaaataccacttactactccatccatccatccatagtagactggtagttgtattagtagtagttagctgctgctttggttattaggattaggatgaagaaactagcagattgttaagtattcttcatgtgactttgttatcttcctttgtaaacaatctcccccaaatataatagcatatcgactaagtggtaatatacttattttttttttaagttgatggtgaactattgtatatggcagggctggtgtttgtctgatcatctgcagcgagctgatagtattattattatgtctctttttggaaatgtctctgccattaacctaactggaaactgtctgctatcaatcactagttccagagatgttttgtcatttcggcacggtgatactatgggttatcgcttgcaatcccccccttcttttattaccaaaactaacaaaaatgtctcccctttgaaggtacaacctctgccacatgtatttcattatcactcacaaaatcaattctaatgtctttgtttatctgtgctaaacaggtagtttgtgtcgactatccaagaccagacctcgataacacctctaatttcttggaagctgcttatttgtcttctaccttccgagcttctccacgcccacctaagccattgaaggttgtaattgctggtgcaggtaaaaccttcatacgtcattatattgtcttttaagtcgcttttgtttgagaatttgatactgccacatctgatagataaccaaatgatacttctagtgtatccccaatgatgctttttatgccacatactaacatctgctttaatttgctatcccacttacttttgcaaacttcgcatatgcaggtctcgctggtttatcaactgcaaagtacttggctgatgccggtcacaagccaattttgctagaagcaagagatgttcttggtggaaaggtaaacgatttataagaaattacaataggatcggaagtcctaggatcccccctccctcttaccttcttctatataacagagcaagcttggtaataaaacaaggattttgggtctaattattctcttctttacttgctttctgttttcgtctctttcactgataaccaaaggcaatatcagttagggttctaggatgggtcgaagcaaattttagggataccaatgcctaaccaagttcgatcaagactagggatatagagggtattcaatcagcttctggtgggattatagctcgcgactttgaagctagagttagggttctttaaagcctaacatagttcaaatacggctggggtgttgggggttcctttctgtacgaatttaaagctggacaaggcagcaaaagagttcgacttgtgtggatttttatctaggtttggctggggtttcaaacaaccgaaggtgtgtttggggttcttgggatagtcgatcaacattggagtgtctttttcctgttttacaagttagaatacgtgaaatgcatcttcgttcattattttgcttttgacctttatgtgatgggtacaagtttaacaacctactgcatgcggtttctctttgtgctcacatttcactttctctcttttctcttttgcattgttggggtgggatggctgtttttgctagtaacatttatacaaacctggacctaatgttaggtcaatccgggctgggttcacaactggatggaggaataagggtcggagggaaatattgaatggctcctcaaacccaaagtaacccagatccaaacacttccaatctaaacaacccagaccccgtggctgctcaatcaacagccatagcatcatctatgaaatcactgcagcaaagaggtagcaatgatcaagacacagtaagccaaacaaaaacagaaatcaagcggcaatttaaatcaatttgaagatgaaggttcatctggtggtaaccaccgtcactacagaccttataataatatcgatttcccaacttttagtattggagaactgtttacaaggctatgagtattgctatcgagtttgaatccaaggttcacatgaaatttaggaaaagtttttcgtcttcagccaaaacagaatcagtaccttcgaaaccaatagaaacttccaacctgttgccctcgattgctgctgcccagaaaccaactgaagcccgtctttttgatgttaaaaaatagggcagattcatacgagaagttgtgtctaagtttctgatctactcaaaatttctatcaatttgccttgggggaaagccgatgtggtactcggtattcaataattaggaacacttacaaagtttaggcaaaatggaaggagatagtcatgaagttcactatggatgttaaggagtacaagctacatggacttccaccagatcgtcaaccatcagcaacatttagcgacctcactactgaaccattcgagttacaggcaagtggactagcagctcattttttcacaactggctagtggacaagtcagattttggggccggatgtattgatacaaacctggacccaatgttgggtcaaaccaggtcgggtcagcagctggatggagggaaaaggggtggagggaaatcaagtagtgaaggaattcaagttaggaagtggaccatgcgcccactacatataattgctccactaattttagtattatatatgtgtgtttttctgttttttaagctggtcaagatactaagtttgtgattgttcttgtattcggagatttgccatctgaattttgctaatattgtgttagactcagtaatctaaattagtagatttccagtttctatcaaatgttcgtttggcgaaaatgaataattgaagttcatatgacgaccttatttgagcaggatctgttctataggctcgtacctctgtatccttgattcctatcaagacagaaaagtagtttcatatgaaatttctatttttaaacttttgtatatcataagtagtcaagcttagcttaatttcaaatctaggttgtcttagtatgttgttacttatcgtgagtgtttttatccacattgctcttctcacataggtagctgcctggaaagatgatgatggagattggtacgagactggtttacacatattttgtaagttttaacttcttatatcctttcaagtgtcgaaaaagagagctgatgtgtgcataaaaagttattcccataatataattctcaacagggttgttgtcgtctttttgtgcactatctatctgctctaagttattgtttctccacgtacctttccttttggacatttgtcactagacacctaatgtgcaataaacttcttcatttgcttgaagttggagcttacccgaatatacagaatctgtttggagagttaggcattaatgatagattgcagtggaaggagcattcaatgatatttgcgatgccaaacaaacctggagaatttagtcggtttgatttcccagatgttctgccggcaccattgaatggtaagtatgctattattagcctattttttttggtgtatatattttatttaaatgatttggtggtgagcattttctgcatcaccaacatgacaaaaaagatctaaaacaagatcagtcagggaatgctagattactaacaaatgtgactctgcataccatctcaggaatttgggctatcttgaggaacaatgaaatgctgacatggcctgagaaagtaaaatttgctatcgggctcttgcctgcaatgttaggtggacaggcttatgttgaggcacaagatggtctgagtgttcaagactggatgagacaacgggtatgtagtcgtttatgtaaatatttcttttaccattttttagtttaatacataagaaacaatggccatgatacctggtatatttgataatggtaacgtttctaagtggaagatccagaggtcaaaccttagcaggggctttttttaggaagattgttggctaattaaaccccctgcttaataattcgagttcttgtttcttttgttatgaattttatttaataattaatgcacatttttcatttttccagggcataccagatcgagttactacagaggtgtttattgccatgtcaaaggcattaaacttcatcaatccagatgaactttcaatgcaatgtattctgattgctctgaaccgatttcttcaggtgaaggcatcattctcttagagcttactggttaaataatgatgaaaaattaatctcatgacttttaattccatcttccgtctgtcatatatgataagttggtcacggactcaagtcactaatatattatatggattgattttacgcttgtgattggtcaagtagacaaagcatgcaaagttatatgggtttagtgtaattagtgtctgttgcattgctcactgtatgtctgtattggttgctataagccagcgtgctaccttgaaagcaactctatttccttttccatgatcaagtattattacatatatattgtgcttctagaatccagatacagagatttgggttatttttgtggttttgaaataggagggcggcctctatagttaatctcgaagtgcttattgtacaccatggatttttgaaacaaagagttgatcgctcttatctgtagcttcttaacacttcaatattggcttggttgcaatactacatggcatagacattggacaccatagataatacaacttgtaaattgtttgtaataaatcaacaggagaagcatggttctaagatggcatttttagatggcagcccacctgaaagactttgcatgccaattgttgagcatattgagtcactaggtggccaagtcaggcttaattcacgaatacaaaagatcgagttgaacaaagatggaacagttaggaactttttactttatgatggaaatattattgaaggtgatgcttatgtatttgctactccaggtacatttagagaacgactatttgaatctgtagctttcacatgtctgttggggttgtagctttattgattattttgtgtcaaacagttgatattctgaagcttctgttgcctgaagattggaaagcaattccttacttcaagaagttggataaattagttggtgtcccagttataaacgttcatatatggttagttggatccttcaatataattctaaacatggcacagtaatcattcaccttaatttaatagagtctggcttctgtcttgaccattaatctgacttagtaaaacccctatatgtattctttgtaattgttaaacaccactttcaggtttgacaggaaactcaaaaacacctatgatcacctactcttcagcaggtcacctctcaactcttattcttgcaacactattacttaatttttagtagacaaggctgttgagctttttatttgtatgttattcatgccactgctacctaaacggatcttttacttccatttcaaatgtctggggcgtgtcgtccataaaggttctctacagttcatagagtaacttagagtaagcttacaccccacctattaactaaacaaagcaacacaagttaggctatatggtacatgctaaagtgatggtcaagattgcaccatttgctaccgccttgagataccagtgtcccagcttctgcttacacttcatagtttatactcaaatttaatattggtacaaaaaagagtactgaacctatcagtttagtcttttgtattaattatttagtttgcatgcaggagccctcttctcagtgtatatgccgacatgtctgtaacatgcaaggtaaagacaagacaaacatatatgaaacaaaccattttcttccagacaaacctgctttgctgttttcatatggttccttgtcatgcaaacaatgaggagatggatgtctattggcctctcctctcattcctattttcccggaaaatgggttaaatctgtctttgtaattttatctttgtcgcatgcatgggacataacttctcacaatgcacataactcaaatatttaccaaaacctcccgcatttttaaaaccaggctatatataagttgtaaattacatgatgtgaacccatacctcccatcaaggttgttctgataatagtgctcccattttatacaggaatactatgatcctaaccggtccatgttagagttggtttttgcacctgcagaagaatggatttcacgcagtgactctgatattattgacgctacgatgagtgaactttcaagactatttccggatgaaattgcagcagatcagagcaaagcaaaaatattgaaataccatgtagttaaaaccccaaggttagaaatatcttaccagtaaggggttttcaacgattcggtttacgagctcttcgctttggtttccttgatttgacaatccttgaagctcaaaccaaaaaccaaatcaaaccgaattaatcagaaacaagccaaaccaaataagatggtttggttttggttcgaatgcgattgaaaccaaaccattttcaaataatgcagattttatgctggcaaatgttatctaaactttttggcaaatgaaaatttgctgagattcatttaccaccaaaaacttactatatgaaaagaaatatataatgtattataaacttacattataagttattttaaattaatttgataggaaatatatatatatatatatacacacacatgtatatatatatagaccaattcggttttcgaattggttttgtttaaaaagcaacaactcgtaaatcaaattatcaaaccataaaccgaatttcaaaatcaatttgttgtcaaaccaaactaaaaactcaaaaaaaccaaatgaatttcaataaatttttatttcaatttggtttgataattggtttcatcgacttggatccgtacactgaacacccctacttacatgtactagtactttctgtagattacttagcatgtgaacaccttcatgtttcacccatctgtgaacgttgtaaacttaatttttgtacagttgtatctgcgatatatactagtttgtgacccaatagatagatttattaattatcatatagttatgtaattatatttccatgtattgtttattctatttcataattgtgtaacaggtcagtttacaaaactgtacctgactgtgaaccttgccgtccattacaaagatctccattagagggattctatttagctggcgactacacgaaacaaaagtatctggcttcaatggagggtgctgttctatcaggaaaattttgcgcccaagcgattgtaaaggtaatgttaaagcaactcgtagctggtagttttagaattatttagcaagtgaaagtatttttctctgctgctttttagagtagtgcaatttgcagcagacgaattttgggtatgtgtttataagtgaccataaaaagacaaagtagcctacatattctgttgctcatcttctgatgcatcatgtaacacaggattatgagttgcttgctgccaggagggaagtggttgctgaggcaagccttgtctaactgtatagatgcaagataacttggtaagttaaaaatcagttgaagacaagagcacgtggttctttgcatatttgactttttatggtccttggctgaagtggtaggcttaaggaggtggcagaatttctgggaggagcttttacaagttcagaagaagctaaacataaatacacccatagcaattcattgttctaactgaaacttatttcatatttgtcaaagaaaaaaatacatattcctgttatgtacatagttggttattttcccttgttttatacgtcatgtgtggcatcgaatctattgattatctatacgtattatatgtggcatgtttttttttaattttgcatcctgatctttgattacacttttcaagatttattcactttgcttccatggcatacaagaaaacaatatcaatacagcgagctatctattatctaacttgggagatgcaggtgcatgagaagtgctcaaaacttcaactacttggtgggattaagttgaagtgacactaacccaggtaccaacctcatcccgaaaatctgtgaatattttctttttattcgtcttagttaaaaaaagaaaaaaaagaaacagatgatgcaccagttcaatactttttgttcgataccttgattatttaccaaatgagacacactgtatgtctgtatgtgctttcatcttgtttcattttgtgggaatgtggagtaacaggtataagaatagcaataacacaagtctagttgctgaagagtgtgagcagagtaagattttggtatgataccaagtaaagtaaatgcgtagagagtaaggtttaggtgattccttaatgaaatgggaaccttgtgattgtcaatgagttattaatccattgaatttgaaatttcacaacgtgaaataacttgtgctcttacaaaatgttttgtggtcatatatttaccaatacatgtgtcttcttggacactaaaaaaaatagatagctggtgaagatactatataatttaataataagataagatagcgtctactttgctgaaaagtcaaaactggattaccaaatctcattctcacgtgtcaaaatttgacaggatcttttgaaattcacttgttggacattggcactggatcatgcaaagggatcacatttctcttcaagccttatcccattcccagctatagataccataaatataaacgctggaagtgcagtattgaattacctgatttatgtttttggatgtggggggttttaggaggtgatatgtaatcaaaaacttaacccaatccattcaaagattgtgtgttgtgatatgacctaaagaaagtgagagagagagagattattcttaattctaaagtaataaattgtgaaggcaaataagccgacagcatgttcctgatacacatatccatcacaacatcccctcccaactttgtcacttccattttactccacactatatatacgcacacctctttcaacaatggcttctactgtacagaacatccccacttttttgagctttttcacggtgtctgcatgaagttaagagtttgacatctgctcgcattcaccccccctttggccttgatttcttcccacatataacttcaaacttaattaatgaattgaatgcgacccgactcttttccatgcaaatcagtggtcacttatcaatgttgattgttgactcgatcccatctataaataccccttcttaccattttctctctcagggtcccagctccacatctgtgaggctttttttcttttggtcccaaatctttcaaaaaaacacaaacagaaaatggcaacagctttacaaacaaagatagaagggaatcgtattacaacaaagtgtgcttccttagtaaagaaacagcgagctcgtatatatatcctacgtcgttgtgccaccatgcttctctgctggtacattcaaggagatgaataaatagttgatgctatgacacaaacaacagacatgtttttatcctcgattcttatagtctctatatcccttttttcacatcaactcatgtggctcccgttttcggttcttttctttggcttatacatattcttaaatatgcatgccctaaacttccatctttttaacaccaacggtccgttgcatttaaaggctgttgggtcttgtctcattttctactccctagtttttgtcatgtcttgtttatcttgacctctcttcatttgtcctgtttaaaacactttttttatccaaatggttttcatttgggttttttgggcatctgcatcagaggacaatttcaactttagacatggaccagaaacggggatatgaccagcatgaaggaagcaatcttgcatcaagttggcagcttgaaatgaaggttctacaataacatcttgcgttgtgtcatggtttgtagataattgtctccgctgaaaataaatgacggttcctcacttccttgatatgtaaagcactcataaaatgattaataattcggtgctgctacaaatatatatgttgaagcgcactaaatctgaagttgtgatttattcatcgggatgtttttttctttttaataatgactttttcatcatttaagttgacatatacagcacccactaatgctaatatcttaaatctccacatttcccttgcaatcaccaagacaacttgctgttagcataaccagacactgctactaactttaaccatcaaaagcacataatcccgcaggtcttcaaatccaaatgaggccggacatcatagaacttgtaattttaactcacatagaagtttgatagtgtgatatatgacaagggcagatggtaataagtagagctagcaaatccttttcatattgttaatcctctctcaaaatggacgaggaagctctaaaactgcagaaaacaaacttttacaaacgaatttaaagctttaagagggaataaggaacaggcatgtcattgaagaatgctatctatttattatggaagatctgtgaccttaaaatcccataaatatgatatgtgtcggatcgtccagaatgaaaagtagctcaagttgttagaaatgttaagtagacacagatgttgtatggaactatggaagttcacttatctactgtaatgagcttccatctctcccaatgaattccaaaaccctgactcaccttcaaattaattccagctcgtgaaccaaatttgtgattctggacaccaacccttatcaaagaatttaattaaattggcaattgacttgagatgtttgaaattcaattttagagaatagaagtttcatacaatcaacgaatgaactttattacatctgtgtattttaacagcgtacgtttcctgcttaactcgagtgctggatccaacccatatcaaaatacgcatgttaccggcgcatctggtctagtctgattccatggatacatgttccgtgttccgttcagaaggttatgtttctaccagaagacagttacaggtactggttaacaagtctattgtaaatcatatacttttacaatggcattgatgtatctgttaacatagtggaagatgcggtacaaaggaatatgaacaggcttctttgtgaaagatgtatctattcaacagccagccatagctggaaaaagtgtctctatagtctatatacattaatgcacggtcatcaggtaaaaattcctttgcaaaaaggaaccacaaacaaaaagcaaaggcgagtaaaaaaaaaaaagaacctaagtgagagattgcctgcacagacaactaattacaatgtacattgactcgcacacttcgcaatgacacaatactctgatttctatatatatgtgtatgtgcatttacatttgccctttattttggtatccgatggttgggcccaacattatggagccaatcaaccacttcattaatggttggcctcttgacggggtttacgttcacacacatacaggcgacatcaagaacctgcagcatctcttcttcaaatcccttgtctctcaggatctcatcaaatatttgatcctgtttcccttctattctaagttgttgcacccacacaaccaattctctagacgcctttggccggaatacctccatgggcctctttcctgtaagcagctcaagcatgacaaccccaaaactgtatatgtcccctctcaaggtggctatccatgactggctgtactccggtggaatataccccagggtgcccaccaactcagtcgtgacgtgtgtattgtatggatgaatcaatctagacaatccaaaatcggccacgtatgcttcaaattggtcatccagaaggatgttacttgatttgatgtcacgatgcacgatatgtggttcgcatacttggtgcatataagccagtccacaacttgctccccgggcgatcttcaatctcgttggccaatcgagcctggatgctccgtcagccttctcatgtagccagtagtccaagcttccattttccatatacgaataaatcagcagctgacatccatcatgtacacagtacccttgtaaagaaaccagatttttgtgatgggcagttgataatgcctccacttctgctttaaactcccttgcaatgaggcccatatctcctgaaagtttcttgacagccagttttgttccgttcgccaaagttgctttgtaaaccaatccaaagcccccacatccaatgatgtttgcttgactgaaatcttcggttgctttcaaaatatcagttatggttagatgtttgatgtcttttgcattgtgcgggaacaatatgactccgctggtatccttgggaacctctacggccgacgtagaattgaaggacaccgtgtccatatggaagacttccgggtcacctctggggagaatccttcttttggacaatatccacagtgccagacaagccagagtgatgccaaccccaaaacagatgcccaggatgaggccgacgatgagtttcttgtttgggcctttttcatgtggcgaggaagcgtctgttttgggtgatagaggattattttcatcgttgcaaaggttttgcatgggtggaccgcacaaccctggattgccttcgtagttctggttcaagaaggtgtcaaactgtcccccggtcggtatggaaccttgtagcttgttgtaagcgacgttgaaagaagacagaaagtacaagcttttgagggaggcagggatctgaccagacagattgttatgggagaggtccagcttttccaagtttgtgagatttgaaatggtagcgggaatggagccagagaaattgtttaggctgagatcaagtgtatgaatggactgcatattaccaatctcaacaggtaggctgccaccgagttgattgcttgacaggtacaatgctggaggcagggtggccagctgattgtactgcaagtaggatgcattttgaggggcaacgaatacagggagttccaggtaactgctgtttacacggtccaaaacctgctgcgatgcgagggctgggagtctggtaagctccacagggaatcccccggatagagaattattagacaggtccagatagaagaggttcggaagcgtgtgtagccagcccggaatgacgccgtcgatattattctgggagaggtcgatgacctccagattggtaagggaagagagccacgtggggatctgaccgaacagcttgcagccaccaagacccatgatcttgagattggagaaaccagagatgggttgaggggggaggggttcgttgaagaagttcttggagaggatgagggtggtgagtttcggatgcctgctcaggatattgaatgcgcttgtgatgttcctgagggtgttgtttgaaagggagaggaaggagagagcaggcaggccgaggacatgagcggggatttcccctcgcagcctgttggtggccagccggattgcggtgagcgatttgcaagagaagacggtggccggcagctcccctgcgaatcggttttcgccaaggtcaaggatggtgagcctggtgaaaccggagaaatcaaaatccgagagaatgccggtgaaggagttgaccctgagattgagaagctgcagggatttgcagttgacgagggaaggaggaagggttccattgagacggttgatgtgaagttcaagtttctgcaacaaggggaggttgccaatggcgtgggggatgggcccgctaaagttgttgccaaacaaggcaagagtggtgaggttggtgagggtggtgatggaatcgggaatggggccggtgagagagttcccagggaacgatagatggcggagggaaggggtggtggaaacgtggaaaggggcaagggcgccggtgaggttgttaaaccccagactcaaaacctggagggaagcacaggggcccgacaaaggggggaaatccccggtgaagtcgttcaaggagagatcgaggatggtcagattagagttgcatatggtggaggtggggacggggcctgtcaaggtgttgttgctgacattgagggcaatcaaagaagggaaagaagggaagaaggtaggcggaatcgtgccattcagataattactggacagattcagggtggagatggtggtcgtggtgggttgtggcaggttcccagaaagtctgttgtaacttaagtcaacggtgtggagatggttgaaaaattgtggtgggaggggaccagataggaaattacaggacaggtttaggaaagatagggatgtcagattttcaagaggggcataataatcattgtaattggtcgtagtaaggcctctatttggtaaggaaatcccgaccacacggtgaccttgatcatcacaactgattccatcccacaaacagcaatcttctccttccccattggcagcagcccagttgacgacgctgggaaagttgttgccaaaaagcaacagagaatccttatcatcagagttacaagctgctgctgctgtcgtccttgtacaagcaggaaacaacaaaactaacactaacactagtatcatcaacaaacccctccccacatgatcatgctcacgattatgattgaatgatgaacaacaacacgggaccaacagcatcatcaacaaccaaaccaaaccacaccacaccacccacccacaaacaaacaaagatatatatatatatatatatattactttttgtttctaaaaagaaagaagaaaattatgaagagaaaaagacgacgataatggtaataatcccatttcaattcaaagaaagaaagaaaaaatacaagtggatgttgacgcagaccattagtaaaaaaaaaaaaaaagagaagggcatcaaatcaaatcaaatcaattgaataaattatataattagaaaaaattacaaatagagagggtgtttctattcatttatccattattattattattatt

SEQ ID NO: 41 - DNA, 9016 bp, Conyza canadensis
acacacacatgtatatatatatagaccaattcggttttcgaattggttttgtttaaaaagcaacaactcgtaaatcaaattatcaaaccataaaccgaatttcaaaatcaatttgttgtcaaaccaaactaaaaactcaaaaaaaccaaatgaatttcaataaatttttatttcaatttggtttgataattggtttcatcgacttggatccgtacactgaacacccctacttacatgtactagtactttctgtagattacttagcatgtgaacaccttcatgtttcacccatctgtgaacgttgtaaacttaatttttgtacagttgtatctgcgatatatactagtttgtgacccaatagatagatttattaattatcatatagttatgtaattatatttccatgtattgtttattctatttcataattgtgtaacaggtcagtttacaaaactgtacctgactgtgaaccttgccgtccattacaaagatctccattagagggattctatttagctggcgactacacgaaacaaaagtatctggcttcaatggagggtgctgttctatcaggaaaattttgcgcccaagcgattgtaaaggtaatgttaaagcaactcgtagctggtagttttagaattatttagcaagtgaaagtatttttctctgctgctttttagagtagtgcaatttgcagcagacgaattttgggtatgtgtttataagtgaccataaaaagacaaagtagcctacatattctgttgctcatcttctgatgcatcatgtaacacaggattatgagttgcttgctgccaggagggaagtggttgctgaggcaagccttgtctaactgtatagatgcaagataacttggtaagttaaaaatcagttgaagacaagagcacgtggttctttgcatatttgactttttatggtccttggctgaagtggtaggcttaaggaggtggcagaatttctgggaggagcttttacaagttcagaagaagctaaacataaatacacccatagcaattcattgttctaactgaaacttatttcatatttgtcaaagaaaaaaatacatattcctgttatgtacatagttggttattttcccttgttttatacgtcatgtgtggcatcgaatctattgattatctatacgtattatatgtggcatgtttttttttaattttgcatcctgatctttgattacacttttcaagatttattcactttgcttccatggcatacaagaaaacaatatcaatacagcgagctatctattatgtaacttgggagatgcaggtgcatgagaagtgctcaaaacttcaactacttggtgggattaagttgaagtgacactaacccaggtaccaacctcatcccgaaaatctgtgaatattttctttttattcgtcttagttaaaaaaagaaaaaaaagaaacagatgatgcaccagttcaatactttttgttcgataccttgattatttaccaaatgagacacactgtatgtctgtatgtgctttcatcttgtttcattttgtgggaatgtggagtaacaggtataagaatagcaataacacaagtctagttgctgaagagtgtgagcagagtaagattttggtatgataccaagtaaagtaaatgcgtagagagtaaggtttaggtgattccttaatgaaatgggaaccttgtgattgtcaatgagttattaatccattgaatttgaaatttcacaacgtgaaataacttgtgctcttacaaaatgttttgtggtcatatatttaccaatacatgtgtcttcttggacactaaaaaaaatagatagctggtgaagatactatataatttaataataagataagatagcgtctactttgctgaaaagtcaaaactggattaccaaatctcattctcacgtgtcaaaatttgacaggatcttttgaaattcacttgttggacattggcactggatcatgcaaagggatcacatttctcttcaagccttatcccattcccagctatagataccataaatataaacgctggaagtgcagtattgaattacctgatttatgtttttggatgtggggggttttaggaggtgatatgtaatcaaaaacttaacccaatccattcaaagattgtgtgttgtgatatgacctaaagaaagtgagagagagagagattattcttaattctaaagtaataaattgtgaaggcaaataagccgacagcatgttcctgatacacatatccatcacaacatcccctcccaactttgtcacttccattttactccacactatatatacgcacacctctttcaacaatggcttctactgtacagaacatccccacttttttgagctttttcacggtgtctgcatgaagttaagagtttgacatctgctcgcattcaccccccctttggccttgatttcttcccacatataacttcaaacttaattaatgaattgaatgcgacccgactcttttccatgcaaatcagtggtcacttatcaatgttgattgttgactcgatcccatctataaataccccttcttgccattttctctctcagggtcccagctccacatctgtgaggctttttttcttttggtcccaaatctttcaaaaaaacacaaacagaaaatggcaacagctttacaaacaaagatagaagggaatcgtattacaacaaagtgtgcttccttagtaaagaaacagcgagctcgtatatatatcctacgtcgttgtgccaccatgcttctctgctggtacattcaaggagatgaataaatagttgatgctatgacacaaacaacagacatgtttttatcctcgattcttatagtctctatatcccttttttcacatcaactcatgtggctcccgttttcggttcttttctttggcttatacatattcttaaatatgcatgccctaaacttccatctttttaacaccaacggtccgttgcatttaaaggctgttaggtcttgtctcattttctactccctagtttttgtcatgtcttgtttatcttgacctctcttcatttgtcctgtttaaaacactttttttatccaaatggttttcatttgggttttttgggcatctgcatcagaggacaatttcaactttagacatggaccagaaacggggatatgaccagcatgaaggaagcaatcttgcatcaagttggcagcttgaaatgaaggttctacaataacatcttgcgttgtgtcatggtttgtagataattgtctccgctgaaaataaatgacggttcctcacttccttgatatgtaaagcactcataaaatgattaataattcggtgctgctacaaatatatatgttgaagcgcactaaatctgaagttgtgatttattcatcgggatgtttttttctttttaataatgactttttcatcatttaagttgacatatacagcacccactaatgctaatatcttaaatctccacatttcccttgcaatcaccaagacaacttgctgttagcataaccagacactgctactaactttaaccatcaaaagcacataatcccgcaggtcttcaaatccaaatgaggccggacatcatagaacttgtaattttaactcacatagaagtttgatagtgtgatatatgacaagggcagatggtaataagtagagctagcaaatccttttcatattgttaatcctctctcaaaatggacgaggaagctctaaaactgcagaaaacaaacttttacaaacgaatttaaagctttaagagggaataaggaacaggcatgtcattgaagaatgctatctatttattatggaagatctgtgaccttaaaatcccataaatatgatatgtgtcggatcgtccagaatgaaaagtagctcaagttgttagaaatgttaagtagacacagatgttgtatggaactatggaagttcacttatctactgtaatgagcttccatctctcccaatgaattccaaaaccctgactcaccttcaaattaattccagctcgtgaaccaaatttgtgattctggacaccaacccttatcaaagaatttaattaaattggcaattgacttgagatgtttgaaattcaattttagagaatagaagtttcatacaatcaacgaatgaactttattacatctgtgtattttaacagcgtacgtttcctgcttaactcgagtgctggatccaacccatatcaaaatacgcatgttaccggcgcatctggtctagtcttattccatggatacatgttccgtgttccgttcagaaggttatgtttctaccagaagacagttacaggtactggttaacaagtctattgtaaatcatatacttttacaatggcattgatgtatctgttaacatagtggaagatgcggtacaaaggaatatgaacaggcttctttgtgaaagatgtatctattcaacagccagccatagctggaaaaagtgtctctatagtctatatacattaatgcacggtcatcaggtaaaaattcctttgcaaaaaggaaccacaaacaaaaagcaaaggcgagtaaaaaaaaaaaaagaacctaagtgagagattgcctgcacagacaactaattacaatgtacattgactcgcacacttcgcaatgacacaatactctgatttctatatatatgtgtatgtgcatttacatttgccctttattttggtatccgatggttgggcccaacattatggagccaatcaaccacttcattaatggttggcctcttgacggggtttacgttcacacacatacaggcgacatcaagaacctgcagcatctcttcttcaaatcccttgtctctcaggatctcatcaaatatttgatcctgtttcccttctattctaagttgttgcacccacacaaccaattctctagacgcctttggccggaatacctccatgggcctctttcctgtaagcagctcaagcatgacaaccccaaaactgtatatgtcccctctcaaggtggctatccatgactggctgtactccggtggaatataccccagggtgcccaccaactcagtcgtgacgtgtgtattgtatggatgaatcaatctagacaatccaaaatcggccacgtatgcttcaaattggtcatccagaaggatgttacttgatttgatgtcacgatgcacgatatgtggttcgcatacttggtgcatataagccagtccacaacttgctccccgggcgatcttcaatctcgttggccaatcgagcctggatgctccgtcagccttctcatgtagccagtagtccaagcttccattttccatatacgaataaatcagcagctgacatccatcatgtacacagtacccttgtaaagaaaccagatttttgtgatgggcagttgataatgcctccacttctgctttaaactcccttgcaatgaggcccatatctcctgaaagtttcttgacagccagttttgttccgttcgccaaagttgctttgtaaaccaatccaaagcccccacatccaatgatgtttgcttgactgaaatcttcggttgctttcaaaatatcagttatggttagatgtttgatgtcttttgcattgtgcgggaacaatatgactccgctggtatccttgggaacctctacggccgacgtagaattgaaggacaccgtgtccatatggaagacttccgggtcacctctggggagaatccttcttttggacaatatccacagtgccagacaagccagagtgatgccaaccccaaaacagatgcccaggatgaggccgacgatgagtttcttgtttgggcctttttcatgtggcgaggaagcgtctgttttgggtgatagaggattattttcatcgttgcaaaggttttgcatgggtggaccgcacaaccctggattgccttcgtagttctggttcaagaaggtgtcaaactgtcccccggtcggtatggaaccttgtagcttgttgtaagcgacgttgaaagaagacagaaagtgcaagcttttgagggaggcagggatctgaccagacagattgttatgggagaggtccagcttttccaagtttgtgagatttgaaatggtagcgggaatggagccagagaaattgtttaggctgagatcaagtgtatgaatggactgcatattaccaatctcaacaggtaggctgccaccgagttgattgcttgacaggtacaatgctggaggcagggtggccagctgattgtactgcaaataggatgcattttgaggggcaacgaatacagggagttccaggtaactgctgtttacacggtccaaaacctgctgcgatgcgagggctgggagtctggtaagctccacagggaatcccccggatagagaattattagacaggtccagatagaagaggttcggaagcgtgtgtagccagcccggaatgacgccgtcgatattattctgggagaggtcgatgacctccagattggtaagggaagagagccacgtggggatctgaccgaacagcttgcagccaccaagacccatgatcttgagattggagaaaccagagatgggttgaggggggaggggttcgttgaagaagttcttggagaggatgagggtggtgagtttcggatgcctgctcaggatattgaatgcgcttgtgatgttcctgagggtgttgtttgaaagggagaggaaggagagagcaggcaggccgaggacatgagcggggatttcccctcgcagcctgttggtggccagccggattgcggtgagcgatttgcaagagaagacggtggccggcagctcccctgcgaatcggttttcgccaaggtcaaggatggtgagcctggtgaaaccggagaaatcaaaatccgagagaatgccggtgaaggagttgaccctgagattgagaagctgcagggatttgcagttgacgagggaaggaggaagggttccattgagacggttgatgtgaagttcaagtttctgcaacaaggggaggttgccaatggcgtgggggatgggcccgctaaagttgttgccaaacaaggcaagagtggtgaggttggtgagggtggtgatggaatcgggaatggggccggtgagagagttcccagggaacgatagatggcggagggaaggggtggtggaaacgtggaaaggggcaagggcgccggtgaggttgttaaaccccagactcaaaacctggagggaagcacaggggcccgacaaaggggggaaatccccggtgaagtcgttcaaggagagatcgaggatggtcagattagagttgcatatggtggaggtggggacggggcctgtcaaggtgttgttgctgacattgagggcaatcaaagaagggaaagaagggaagaaggtaggcggaatcgtgccattcagataattactggacagattcagggtggagatggtggtcgtggtgggttgtggcaggttcccagaaagtctgttgtaacttaagtcaacggtgtggagatggttgaaaaattgtggtgggaggggaccagataggaaattacaggacaggtttaggaaagatagggatgtcagattttcaagaggggcataataatcattgtaattggtcgtagtaaggcctctatttggtaaggaaatcccgaccacacggtgaccttgatcatcacaactgattccatcccacaaacagcaatcttctccttccccattggcagcagcccagttgacgacgctgggaaagttgttgccaaaaagcaacagagaatccttatcatcagagttacaagctgctgctgctgtcgtccttgtacaagcaggaaacaacaaaactaacactaacactagtatcatcaacaaacccctccccacatgatcatgctcacgattatgattgaatgatgaacaacaacacgggaccaacagcatcatcaacaaccaaaccaaaccacaccacaccacccacccacaaacaaacaaagatatatatatatatatatatatatatatattactttttgtttctaaaaagaaagaagaaaattatgaagagaaaaagacgacgataatggtaataatcccatttcaattcaaagaaagaaagaaaaaatacaagtggatgttgacgcagaccattagtaaaaaaaaaaaaaagagaagggcatcaaatcaaatcaaatcaattgaataaattatataattagaaaaaattacaaatagagagggtgtttctattcatttatccattattattattattattattattattattatattattactacttgctactattctattttaattacattattattattaattatgtatgatataatgagagagttgaagaacaactagatattaatcaaatccatccatccatccatcatgacgacgaccaatagagagagagagagagcgcgcgtttactttgtttattttatatgagtagtaagtatttgatgtttttattttaatcaaggaaattactgtaattaaattcaattgacttgaattggtggaaggagggagggtgggggcggctgttcgctcatcagtcatcaccatccatctctcatcgtgtcatgatgtatatatatatattatatatatatagagagagagagggagattaataaaatacaaatggacaaatgcaaatgggaattattattattattattatttatttagctttatatggatatggaaatggatggtgtgggcatctcatcaaatcaaatagaatccaaccattacaagtgcgcctttttccttttctttctaaagtggagagacggattgagtgagggagggactattaccaataccaattataccatggttagtggcggtggtggtacgactattaccaaaactaattataccatcaatatataatcactaatatatatatatatatatatggtaacactccgataagaacacttttaaaataagaacggtgaaaacaccttaaaaacatcattttgat

SEQ ID NO: 42 - DNA, 8264 bp, Conyza canadensis
ttaaagatattttcctcccacttttgggataatttggaaggaaggaaactccactccttctcttctttccccttcctttacatataaactcgagaacacaggctaaggttcaagtttcaagtcttacatttgattactagccaaaacattaattagttattgttatgcaaaaaaaaaaaaaaaaaattataaaaattgaattgattgttaatcaatatcattttatgttgagttatttgttttagtattatattaaaagtaaaataatgctacatgaatttttctttttttctttcttaagcattcaatgcgattttaattaaaataaaataaaatagactatcatttgtagctaattatgtaacatatcaactatgttttatacaatactagcattatattcgtgcgatgcggcggtggtcgtgacgacgaaagtgtggtggtggaggcgagtgttggtggtgaatgcgacgtcgagtgccgtagataattcatataaaagtaattgatttaaaaggttaatggagatattttagaaaaataaaggattgatagtgtaatttaattattaatattaagagaatagtgtatgtgaaaatcttttaaaggtttgtaggcttgtagccttgtaggtgaaaatattacataggagggcattttagacatttccccatgtaactttcaacatggagggtattttctttaatatagagtataaataatggagatatttaaaaaaaataaaggactgatagtgtaatttaattattaatattaagaaaatagtgtatgtgaaaatattttaaagggttgtaggcttgtagccttgtaggtgaaaatattacataggaggacattttagacatttcccccatgtaactttcaacatggggggtattttctttaatatagagtataaatatagataaataatatatattttgtaaattttttaaactaataaattattttaaaataataatttttataaaatatattttatttgataaataataactctaaattacacagatggtacctataatttgtattatattacatgtttcatacctcacatgcaagacacgttggctacttaatgatacaactaacgaccgtcagcgtgaggtatcttctaagtgtaaaattataaacatgatataattgacgtaatttaaatctaacaggtatgaaattaataatttcgaccaaaccaaaggtacttaattcactcttaatatactgtatctaatactactcgtggtagtattatgtagattcctagcaatggacgacaatattccaacaacataagaagccaaaacccacttccttcctttttttttttgttgttgaataatttaatcagtttttaggaacgaacaacctcctccatttccagataaattattattcagccaagcaaaaaacacaacatcccttgtttcctcttcttcttgttttctttttctttctttttgctaaaaaactcacacacgcagaagaagaagacgaagacaaagtcagagagttgagtttggactgattgattgatttgttattaaggtaaaaataccacttactactccatccatccatccatccatagtagactggtagttgtattagtagtagttagctgctgctttggttattaggattaggatgaagaaactagcagattgttaagtattcttcatgtgactttgttatcttcctttgtaaacaatctcccccaaatataatagcatatcgactaagtggtaatatacttattttttttttaagttgatggtgaactattgtatatggcagggctggtgtttgtctgatcatctgcagcgagctgatagtattattattatgtctctttttggaaatgtctctgccattaacctaactggaaactgtctgctatcaatcactagttccagagatgttttgtcatttcggcacggtgatactatgggttatcgcttgcaatcccccccttcttttattaccaaaactaacaaaaatgtctcccctttgaaggtacaacctctgccacatgtatttcattatcactcacaaaatcaattctaatgtctttgtttatctgtgctaaacaggtagtttgtgtcgactatccaagaccagacctcgataacacctctaatttcttggaagctgcttatttgtcttctaccttccgagcttctccacgcccacctaagccattgaaggttgtaattgctggtgcaggtaaaaccttcatacgtcattatattgtcttttaagtcgcttttgtttgagaatttgatactgccacatctgatagataaccaaatgatacttctagtgtatccccaatgatgctttttatgccacatactaacatctgctttaatttgctatcccacttacttttgcaaacttcgcatatgcaggtctcgctggtttatcaactgcaaagtacttggctgatgccggtcacaagccaattttgctagaagcaagagatgttcttggtggaaaggtaaacgatttataagaaattacaataggatcggaagtcctaggatcccccctccctcttaccttcttctatataacagagcaagcttggtaataaaacaaggattttgggtctaattattctcttctttacttgctttctgttttcgtctctttcactgataaccaaaggcaatatcagttagggttctaggatgggtcgaagcaaattttagggataccaatgcctaaccaagttcgatcaagactagggatatagagggtattcaatcagcttctggtgggattatagctcgcgactttgaagctagagttagggttctttaaagcctaacatagttcaaatacggctggggtgttgggggttcctttctgtacgaatttaaagctggacaaggcagcaaaagagttcgacttgtgtggatttttatctaggtttggctggggtttcaaacaaccgaaggtgtgtttggggttcttgggatagtcgatcaacattggagtgtctttttcctgttttacaagttagaatacgtgaaatgcatcttcgttcattattttgcttttgacctttatgtgatgggtacaagtttaacaacctactgcatgcggtttctctttgtgctcacatttcactttctctcttttctcttttgcattgttggggtgggatggctgtttttgctagtaacatttatacaaacctggacctaatgttaggtcaatccgggctgggttcacaactggatggaggaataagggtcggagggaaatattgaatggctcctcaaacccaaagtaacccagatccaaacacttccaatctaaacaacccagaccccgtggctgctcaatcaacagccatagcatcatctatgaaatcactgcagcaaagaggtagcaatgatcaagacacagtaagccaaacaaaaacagaaatcaagcggcaatttaaatcaatttgaagatgaaggttcatctggtggtaaccaccgtcactacagaccttataataatatcgatttcccaacttttagtattggagaactgtttacaaggctatgagtattgctatcgagtttgaatccaaggttcacatgaaatttaggaaaagtttttcgtcttcagccaaaacagaatcagtaccttcgaaaccaatagaaacttccaacctgttgccctcgattgctgctgcccagaaaccaactgaagcccgtctttttgatgttaaaaaatagggcagattcatacgagaagttgtgtctaagtttctgatctactcaaaatttctatcaatttgccttgggggaaagccgatgtggtactcggtattcaataattaggaacacttacaaagtttaggcaaaatggaaggagatagtcatgaagttcactatggatgttaaggagtacaagctacatggacttccaccagatcgtcaaccatcagcaacatttagcgacctcactactgaaccattcgagttacaggcaagtggactagcagctcattttttcacaactggctagtggacaagtcagattttggggccggatgtattgatacaaacctggacccaatgttgggtcaaaccaggtcgggtcagcagctggatggagggaaaaggggtggagggaaatcaagtagtgaaggaattcaagttaggaagtggaccatgcgcccactacatataattgctccactaattttagtattatatatgtgtgtttttctgttttttaagctggtcaagatactaagtttgtgattgttcttgtattcggagatttgccatctgaattttgctaatattgtgttagactcagtaatctaaattagtagatttccagtttctatcaaatgttcgtttggtgaaaatgaataattgaagttcatatgacgaccttatttgagcaggatctgttctataggctcgtacctctgtatccttgattcctatcaagacagaaaagtagtttcatatgaaatttctatttttaaacttttgtatatcataagtagtcaagcttagcttaatttcaaatctaggttgtcttagtatgttgttacttatcgtgagtgtttttatccacattgctcttctcacataggtagctgcctggaaagatgatgatggagattggtacgagactggtttacacatattttgtaagttttaacttcttatatcctttcaagtgtcgaaaaagagagctgatgtgtgcataaaaagttattcccataatataattctcaacagggttgttgtcgtctttttgtgcactatctatctgctctaagttattgtttctccacgtacctttccttttggacatttgtcactagacacctaatgtgcaataaacttcttcatttgcttgaagttggagcttacccgaatatacagaatctgtttggagagttaggcattagtgatagattgcagtggaaggagcattcaatgatatttgcgatgccaaacaaacctggagaatttagtcggtttgatttcccagatgttctgccggcaccattgaatggtaagtatgctattattagcctattttttttggtgtatatattttatttaaatgatttggtggtgagcattttctgcatcaccaacatgacaaaaaagatctaaaacaagatcagtcagggaatgctagattactaacaaatgtgactctgcataccatctcaggaatttgggctatcttgaggaacaatgaaatgctgacatggcctgagaaagtaaaatttgctatcgggctcttgcctgcaatgttaggtggacaggcttatgttgaggcacaagatggtctgagtgttcaagactggatgagacaacgggtatgtagtcgtttatgtaaatatttcttttaccattttttagtttaatacataagaaacaatggccatgatacctggtatatttgataatggtaacgtttctaagtggaagatccagaggtcaaaccttagcaggggctttttttaggaagattgttggctaattaaaccccctgcttaataattcgagttcttgtttcttttgttatgaattttatttaataattaatgcacatttttcatttttccagggcataccagatcgagttactacagaggtgtttattgccatgtcaaaggcattaaacttcatcaatccagatgaactttcaatgcaatgtattctgattgctctgaaccgatttcttcaggtgaaggcatcattctcttagagcttactggttaaataatgatgaaaaattaatctcatgacttttaattccatcttccgtctgtcatatatgataagttggtcacggactcaagtcactaatatattatatggattgattttacgcttgtgattggtcaagtagacaaagcatgcaaagttatatgggtttagtgtaattagtgtctgttgcattgctcactgtatgtctgtattggttgctataagccagcgtgctaccttgaaagcaactctatttccttttccatgatcaagtattattacatatatattgtgcttctagaatccagatacagagatttgggttatttttgtggttttgaaataggagggcggcctctatagttaatctcgaagtgcttattgtacaccatggatttttgaaacaaagagttgatcgctcttatctgtagcttcttaacacttcaatattggcttggttgcaatactacatggcatagacattggacaccatagataatacaacttgtaaattgtttgtaataaatcaacaggagaagcatggttctaagatggcatttttagatggcagcccacctgaaagactttgcatgccaattgttgagcatattgagtcactaggtggccaagtcaggcttaattcgcgaatacaaaagatcgagttgaacaaagatggaacagttaggaactttttactttatgatggaaatattattgaaggtgatgcttatgtatttgctactccaggtacatttagagaacgactatttgaatctgtagctttcacatgtctgttggggttgtagctttattgattattttgtgtcaaacagttgatattctgaagcttctgttgcctgaagattggaaagcaattccttacttcaagaagttggataaattagttggtgtcccagttataaacgttcatatatggttagttggatccttcaatataattctaaacatggcacagtaatcattcaccttaatttaatagagtctggcttctgtcttgaccattaatctgacttagtaaaacccctatatgtattctttgtaattgttaaacaccactttcaggtttgacaggaaactcaaaaacacctatgatcacctactcttcagcaggtcacctctcaactcttattcttgcaacactattacttaatttttagtagacaaggctgttgagctttttatttgtatgttattcatgccactgctacctaaacggatcttttacttccatttcaaatgtctggggcgtgtcgtccataaaggttctctacagttcatagagtaacttagagtaagcttacaccccacctattaactaaacaaagcaacacaagttaggctatatggtacatgctaaagtgatggtcaagattgcaccatttgctaccgccttgagataccagtgtcccagcttctgcttacacttcatagtttatactcaaatttaatattggtacaaaaaagagtactgaacctatcagtttagtcttttgtattaattatttagtttgcatgcaggagccctcttctcagtgtatatgccgacatgtctgtaacatgcaaggtaaagacaagacaaacatatatgaaacaaaccattttcttccagacaaacctgctttgctgttttcatatggttccttgtcatgcaaacaatgaggagatggatgtctattggcctctcctctcattcctattttcccggaaaatgggttaaatctgtctttgtaattttatctttgtcgcatgcatgggacataacttctcacaatgcacataactcaaatatttaccaaaacctcccgcatttttaaaaccaggctatatataagttgtaaattacatgatgtgaacccatacctcccatcaaggttgttctgataatagtgctcccattttatacaggaatactatgatcctaaccggtccatgttagagttggtttttgcacctgcagaagaatggatttcacgcagtgactctgatattattgacgctacgatgagtgaactttcaagactatttccggatgaaattgcagcagatcagagcaaagcaaaaatattgaaataccatgtagttaaaaccccaaggttagaaatatcttaccagtaaggggttttcaacgattcggtttacgagctcttcgctttggtttccttgatttgacaatccttgaagctcaaaccaaaaaccaaatcaaaccgaattaatcagaaacaagccaaaccaaataagatggtttggttttggttcgaatgcgattgaaaccaaaccattttcaaataatgcagattttatgctggcaaatgttatctaaactttttggcaaatgaaaatttgctgagattcatttaccaccaaaaacttactatatgaaaagaaatatataatgtattataaacttacattataagttattttaaattaatttgataggaaatatatatatatatatatacacacacatgtatatat

SEQ ID NO: 43 - DNA, 667 bp, Conyza canadensis
ttattattattattatattattactacttgctactattctattttaattacattattattattaattatgtatgatataatgagagagttgaagaacaactagatattaatcaaatccatccatccatccatcatgacgacgaccaatagagagagagagagagcgcgcgtttactttgtttattttatatgagtagtaagtatttgatgtttttattttaatcaaggaaattactgtaattaaattcaattgacttgaattggtggaaggagggagggtgggggcggctgttcgctcatcagtcatcaccatccatctctcatcgtgtcatgatgtatatatatatattatatatatatagagagagagagggagattaataaaatacaaatggacaaatgcaaatgggaattattattattattattatttatttagctttatatggatatggaaatggatggtgtgggcatctcatcaaatcaaatagaatccaaccattacaagtgcgcctttttccttttctttctaaagtggagagacggattgagtgagggagggactattaccaataccaattataccatggttagtggcggtggtggtacgactattaccaaaactaattataccatcaatatcatcactaatatatatatatatata

SEQ ID NO: 44 - DNA, 97 bp, Conyza canadensis
  unsure (1)..(97): unsure at all n locations
tgtggtggtggaggcgagtgttggtggtggatgcgacgtcgagtgccgtagataattcatataaaagtnnntgatttaaaaggttaatggagatatt

SEQ ID NO: 45 - DNA, 33 bp, Conyza canadensis
tttatttgagagaagaagagaaaagaagggaaa

SEQ ID NO: 46 - DNA, 484 bp, Euphorbia heterophylla
ggcagaagtccccttcttagtgtttatgctgacatgtctcttacatgcaaggaatattataatccaaatcaatcaatgctggagttggtatttgcacctgcagaagaatggatctcacgcacggacaccgagatcatagatgccactatgaaagaactcgcaaaactctttcccgatgaaatagctgcagaccaaagcaaagccaaaattctcaagtatcatgttgtaaagactccccggtcggtttacaagactatcccaaactgtgaaccatgccgccctttgcaaagatcacccgtggaggggttctatttagccggtgactacacaaagcagaagtatttggcttcaatggagggtgctgtcctatctggcaagttttgcgctcaagccattgtacaggattatgagttgcttgctgctcgggagcagacaaaattggctgaggcaaccgttagttaacaatgtaaatactgtttaaggt

SEQ ID NO: 47 - DNA, 347 bp, Euphorbia heterophylla
tattggacttttgccagcaatgcttggtggacaggcatatgttgaggctcaagatggtttgagtgttcaagagtggatgagaaagcagggtgttcctgatcgagtcactaaagaggtgttcattgccatgtcaaaggcactaaactttattaaccctgatgagctttcaatgcaatgtatattgatagcattgaacagatttcttcaggaaaagcatggttctaagatggctttcttggatggaaatcccccagagaggctttgcaagccaattgttgatcacattcagtccttgggtggtgaagtacggctaaattcacgaataaaaaattgatttaaataatgat

SEQ ID NO: 48 - DNA, 5622 bp, Euphorbia heterophylla
aatgtttatggaagggaaaaaatgtgaaatattctgacagacaactaaaattcaataccaatcataaaaaatttaatgaatgattgagattgaccgaaatttacaaatgtatcaaagttcaaatttagagaatccttttacaaactcttatacaagtcacaaattgttaggatgaaaaattatgacttcaaacatcaatcgatacatttaaaaaattatcactcacatcatcaatctatacatgtatgaaatggaaaaatatcactccttatgttaaccgatacaacttcacagtggttgttatatgaaaagatacctttgaagctcaatttaagagtaaccggtaatccttgctggcagaatattctcaacggagaccatacaaaatccaacgctcaataatccaaaaatccatttccacttttccgacctactcctcttcctctttgttatcttcttcttcgtcttgcaatttccaatttctttgtttccaatttctgagttcactgatttctgccctcttcttcttcttcttcttcttcttcttcaattgattttgagcttcaattgatatattactatgacactttatgggggcgtttctccattgaacttgacctttcattctgatatctcagaagctagaaatttgctatcctctttcagatgtcaaaatcatctgctctcttttaaaagcagcgaatctttgggttctcctctgagaacttctattggaaatgctaccaaaacacgatcaaggactgctggttcgtctttgaaggttcgatttattctttttcgtatctttcgccctcgtttttcctttgttcttgttacagtatgtttgcctacttgattgatgatacaggtggtttgtgtggactaccctagacctgatattgacaatactgcaaattttctcgaagctgcttacttgtcttcaacctttcgtgcttctcctcgtccggataaacctttgaaggttgtaattgccggtgcaggtgatcaatttcttatcctaattggttttcttgcttatttcagttcagtgctttttgaagtatgcttgcttcaattttgatttatgggtaggcagggactacaattgattgatttttattttagttttagcgtttaaacattttatttctggaagctgttgtccaagtcaataacttagcatcttgaataaaatctgcaaacttttgtggttatttatatacctcttctgatttggttacaatggattaacaacttttacatcatgctgcagggttggctggtttatcaacggcaaaatatttagcagatgcagggcacaagcctttattacttgaagcaagagatgttcttggaggaaaggttatgctttacctagacttcaagaaaattatgcattgagttaccaattattaaacaatatgaataacaattggtgcaagcaaatgaattggattatagactctgtttgtttgattattgatcttatatagtatatttatttcttatttcttaagactaattcatgggagtctaagagttccatttgctaatgaatatctggcatgtgcttttcgaaatcaatgtcgcaattattattatgatttagctatctagtaggtgcctttggtgcacgttatgcacaccatggacattatttagttgataagcttctgattctcttgtttcaaagtcattaccatgaattaactttctcttatgcttggttcgtattttattttctattcatatactagttttaataattgacattgctgcttaaatgctgttctgggtgggcatcactgacatttaatatgacaagttgaagttcttcattgccgcatatatggttgagttccttcacagttcatgcaaatggtcaagacaattgactttctcttagaagaaagttttcctattttttaacttgaaaggttataatctatgtcctgtttatatgtgctatagtctcatagttgttttcattaaataggtggctgcatggaaagataaagatggggactggtatgagacaggcttgcatatattctgtaagtttcagaacccttttggagtcattgtaatgccacttccatactcgatgtgttgttgttactttccaccttttttgtcaaatcaatttcatagtttcctttgacatgaagatgcaggaaatattttgtatattaatttttttttaaaatattttgctggttgttgtgaatagacattgttaattttatgctggacagagttttctttttccttatttgtttcagatgcttaaacttttgtggtatattgctgttcttattgaacctgtcttctttggtttacaagttggagcatatccaaatgtgcagaacctgtttggagagctaaacatcaatgataggctgcagtggaaggagcattctatgatatttgcaatgccaagcaagccaggggagttcagtcgatttgactttcctgatgttcttccagcacctttaaacggtatacaagttaaacacttcctgaaaattgatttctcatgtgcaactttttaggagctagcgagacctataaaaattgttggtaagcataggaattgtatatttggcttaaattttatgaatggaaacaattgtattttagttgaaaaccagattgaatcattgaactcttatcatgtaactcttatatttcattgattttttttgtatttttcatatttctgctcacattgttgattttttgactaagcacccctttgttttctcagcagtcacctcctgattgttgtcctctacgtgagacagctcttgttgtagacatatccatatatttgtatatcagccaaacatataccttaaatgtatgatttttaattgattctgtctaggcttcaagggatagctaaaaaaggacacatttctctgttttcttgtgggttttgttattgtgatctaggatataactagaggagtagaggttgtcatattataatacaaccttcacaaattcatgatttgtggcaatggagaagtttagaatggtgagttaaaccgtattttggccttcagaagtacccaagatttacaatatgcgtattaattaatgataaatggaaatcaatttcccaatgtatatatcttaaataattgctctatatgcttctattttttttgtgatcttacaatttcctgtcatgcctaaatttttttatggttattcaacttatttatctatagaactatcattttttttttcaatttttgcttattttattgcatactttggtattacctgcaaaatattgcttaaaattaatgtatattttctatggttgtgcttgacagggatatgggccattttaaaaaacaatgagatgctgacatggccggagaaagtgaaatttgctattggacttttgccagcaatgcttggtggacaggcatatgttgaggctcaagatggtttgagtgttcaagagtggatgagaaagcaggtacttttgatagatccaaatcaataagaataacacatggcttcttatgggcacaactctccagccaaggatcatggagtcgcattgatcatcgtgcaatttaaacagaagaaaccagaatactgaactaaaatactcaacattgctcgattaaaaattgatttattttctgaaactagtaaaatctatatatgtatcaagtataacaaataaactctgttcttgatatatatattttttttgtaattttccgtgtttgattgtcagggtgttcctgatcgagtcactaaagaggtgttcattgccatgtcaaaggcactaaactttataaaccctgatgagctttcaatgcaatgtatattgatagcattgaacagatttcttcaggtatgatacttcttctttctctttctattcctcgatgagctttccattaatattttttgaatgaatgtttgttgaacaacattcatgtgtttagttggctgaaaagaagttttgctttttcttttcctttaaataaatgaaattcaaattttcttttacatttttctcagttactcttgaagatgttattgttgaaagattgagcataagccttatataaactcattacaaatttttttatacttttgtcattttttctctattttctagaagtttctcaattttttctttgccacttcacattagatctgtggaagtttcttatataatgaaactaactgaataaggatcgatggtaatatcaacaggaaaagcatggttctaagatggctttcttggatggaaatcccccagagaggctttgcaagccaattgttgatcacattcagtccttgggtggtgaagtacggctaaattcacgaataaaaaaatttgatttaaataatgatggaacaattaagagctttttactgagtaatggggatgtgatagaaggggatgcttatgtttttgccggtccaggtaaacttgaattttggataacaaataacttctattattttcgtgacccatattttctgatactagtgtatttttctttttcctttagttgatatattgaagcttcttttgcctgataactggaaagagattccttacttcaagaaattggataaattagttggagtccctgtcattaatgttcatatatggtcagtgatgaattcttttatcgagtgactgtttatctgagagttcatttactagcacatggttcactaacagaaatatatttcttttccaggtttgaccggaaactaaagaatacatacgatcatctgcttttcagcaggtcctactcttatgcttttctctagctgttcttcgcccatagagatttctacaatcattttcataacttcctgaaaagctgttaattttcatcttttatgaaggaattcagttcattacaaatcattttacgtataaatattttgaatcttgtatgtaaaatgatttcaaatgaattgaattccttctaaaaggaatgttttccaatggagggttgagttgttgctataataagttgaccttctgaatctgatttgtaccaatgaagtttgaagaaatgccttttcccgtgctattgtacatactgattgtatatcttcttttgacttgcagaagtccccttcttagtgtttatgctgacatgtctcttacatgcaaggtaaaactggaactagttatttattttaccaaaacgacttggctgctgctatgctaattacttttgttctatgaaatgaaaagtaatagtggtctgctttttgtctccatacacataatttgggcaaataatatgatctttgtagtctttgacatgttaattacaaacattgaagcatctcaagtatcatcttgtaaaaactccccggttagcgacctattgtctacgaacttcttggctctgaccaaacgccttttgtctatgaactattgatttggggaatttggttcttgacctattgtactcactctagcacgtataacccacaaattagatttgcaactttgctcaatttatatcaatacatgtaaaatagtcaacattatactgcacatctattatcaattgctttaggtatgaccctaatgtctctggtcaataggtcagggac

SEQ ID NO: 49 - DNA, 3393 bp, Euphorbia heterophylla
tcttgcttatttcagttcagcactttttgaagtatgcttgcttcaattttgatttatgggtaggtagggactacaattatttgatttttattttagttttagcgtttaaacattttttctcggaagctgttgtccaagtcaataacttagcatattgttttggaataaaatctgcagacttttgtggttatttatgtacctttttttaatttggttacgatggattaacgccttttacatcatgctgcagggttggctggtttatcaacggcaaaatatttagcagatgcagggcacaagcctttattacttgaagcaagagatgttcttggaggaaaggttatgctttacctagacttcaagaaaattatgcattgagttaccaattattacacaatatgaataacaattggtgcaaacaaatgaattggattatagactctatttgtatgattatttttcatttagctaagactaatgcatgagagtataagagtttcatttgttaatgaatatctggcatgtgtcatttgaaatcaatgtcatcatcattattatgatttggctatctagtaggtgcctttggtgcacattcttccgccattgaaattatttagttgaccggcttctaattctcttgtttcgaattcattaccaaattttatttcttctctatccatccataatatagttttcctatatattagttacattcctccgtttctattctattattagcaagccctgttgtcttgtatatgtctattcatatactagttttatttattggcattgctgctaaagtgctgttctgtacgggcatcactgacatttaatatgactagttgaagttcttcaatgccgcatcaatggttgaattccttcacagttcaagcaaatggtcaaaccaattgactttctctaagaaaaaagtttttcttttttttaacttgaaaggttataatctctttcctgttattatgtgctccaggctcatagttgttttctttaaataggtggctgcatggaaagataaagatggggactggtatgagacaggcttgcatatattctgtaagtttcagaaccctttaggaatgagtcattgtaatgccacttccattctcgttgtgtatttgtatgttaattttacttgtcaccatttttgtgaaatcactttcataatttcccacagtgaattaatttttttttaaatattcttttggttgttgtgaacaggcattgctaatttgatgctggatgtagtttttccttttccttattagtttcagatgcttaaacttttgtggtttattgctttacttattgaacctgtcttctttggtttacaagttggagcatatccaaatgtgcagaacctgtttggagaactaaacatcaatgataggctgcagtggaaggagcattctatgatatttgcaatgccaagcaagccaggggagttcagtcgatttgactttcctgatgttcttccagcacctttaaatggtatacaatttaaacacttcctgaaaattgatttttcatgtgcaacttttaggagctagcgagacctataaaaattgtctgtaagcatagatattgtatattggcttaattttatgaatgaaaacaattgtcttttagttgaaaaccggtttaaattcttatcatgtaatctcttatatttcgttgattttttttgtaattttcatatttctgctcacattgttgatgttttgctaagcacccctttgttttctcggcactcacctctttctgattgttgtcttctacttgagacaactcttgttgcagacatatccatatatttgtatatcagccaaacatatacgttaattgtatgatttgtaattgattctgtttaggcttcaagggatagctaataaagggcacatttctctgttctcttgtggattttattattgtgatataggatataactagaggagtagaggttgtcatataacaataccaccttcgcaaatacatgctttgtagcaatggagaagtttagaatgctgagttaaaccgtattttggccttcagaagtacccaagatttacaatatgcgtattaactaatgataaatggaaagcaatttcccaatgtatatatcttaaataattgctctatatcttctatttttttttttttgtaatcttacaattttctgtcatttctaaaattttttatggtcatttaacttatttatctatataactattgtttttttcaaattttcttagtttattgcatacttcggtattgcctacaaaatattgtttaaaagtaatgtatattttctatggttgtgcttgacagggatatgggccattttaaaaaacaatgagatgctgacttggccggagaaagtgaaatttgctattggacttttgccagcaatgctcggtggacaggcatatgttgaggctcaagatggtttgagtgttcaagagtggatgagaaagcaggtacttttgatagatcaaatcaataagaataacacatggcttcttataggcataactctccagccaagggtcctggagtcgcattgatcatcgtgcaatttaaacagaagaaaccaatactgaactaaaatactcaacattgctcgattaaaaattgatttattttctgaaactagtaaaatctataaatgtatcaagtataacaaataaactctgtttttggtatattttttttgtaattttccctgttcgattgtcagggtgttcctgatcgagtcactaaagaggtattcattgccatgtcaaaggcactaaactttataaaccctgatgagctttcaatgcaatgtatattgatagcattgaatagatttcttcaggtatgattctttttctttctctttctattcctcgatgagctttccattaatattttttgaatgaaggtttgtttaacaactttcatgtgtttagctggctgaaaagaagttttgcttttccttttcctttaaataaacgaaattgaaattttcttttacattttcttggttactcttgaagatgttattgttgaatgattgcacataagccttgaatatactcattacaaattttttatacttttgtcattttttctcttttttctaaaagtttctcaatattatctttaccacttcacataagatctgtggaagtttcttatataatgaaactaactgaataacgatcaatggcaatatcaacaggaaaagcatggttctaagatggctttcttagatggaaatcccccagagaggctttgcatgccaattgttgaacacattcagtccttaggtggtgaagtacgactaaattcacgaataaaaaaatttgagttaaataatgatggaacaattaa

SEQ ID NO: 50 - DNA, 2627 bp, Euphorbia heterophylla
gtaaaactggaactagttatttattttaccaaaacgacttggctgctgctatgctaattacttttgttctatgaaatgaaaagtaatagtggtctgctttttgtctccatacacataatttgggcaaataatatgatctttgtagtctttgacatgttaattacaaacattgaagcatctcaagtatcatcttgtaaaaactccccggttagcgacctattgtctacgaacttcttggctctgaccaaacgccttttgtctatgaactattgatttggggaatttggttcttgacctattgtactcactctagcacgtataacccacaaattagatttgcaactttgctcaatttatatcaatacatgtaaaatagtcaacattatactgcacatctattatcaattgctttaggtatgaccctaatgtctctggtcaataggtcagggacccaaggggaacatctcgatcaatcagcgtccttaagtctagtttttcacttgaatttgtggtcccttgagcttgcttaatttctaggtttgagatgatgtacaaaaacgtcctcacggttgaatggcatttgggctcactacagtcctcaagtgaattaaactttttacactgtttatttaacaaaaagtactaaatcacaatttcttgtggcacaggaatattataatccaaatcaatcaatgctggagttggtatttgcacctgcagaagaatggatctcacgcacggacaccgagatcatagatgccactatgaaagaactcgcaaaactctttcccgatgaaatagctgcagaccaaagcaaagccaaaattctcaagtatcatgttgtaaagactccccggttagtctcctttgaaaaattgcatcgttgattagtatctcacatggttttgaaaaccagaccggactggccagttggaccaggtttgaccagaaccagccactggttcggtcggtgtttagtctaaatccggtcaaaaaccagttgtctgattataacttaaatccggttcgaccaccaacttaatttaattgaaccttaaacctatgaccggtctgaaaggttcaaactaattgtagttgcgtaatgtttgttttacccatatttgtcaaaagtgtgcctcacgaagggcgcgacccttggcgcctcgccatactacaggcgaggtggtgttcctatggcgtacccctaaggcctaggggtgagcattccaataataccgaaccgaattaccaaattttcataaaattttttactgaaccgaatttcatgtgataccgaaatttccaaatgaaattatttcggttatccgaaaaattaaattaattaaaaaatgcaattgacttttcaataaaaaggttttcaaactcaaccagaaaatcttaattcatcgtattgtgaacaaaacataacattagttatctaatagtaattcaaccatacatataaaacagataaaaatattatatggataaaccgaattatgaattttccgagccatactgaaccgaaatgtgaattatccgaaccgaattatgaaatatccgaaccgaaatccgaaatatccgaaccgaattcggttcggtaagttcggtaattcggataataccgaattctgcacaccgctacctaaggcccgcttcaggattttaacttactttaatatgtgttttccatttattttttaagagttctaataattcaaatatttatatctaacatttctcttctcttggttctttttgtggcactgttattgcatttaaagtcacctatcaatcaaattattttttgcgcctagtgtacctggagtgcgccgtgcctggctcctttgcgcctctaacaactatggttttaccttcaggtcggtttacaagactatcccaaactgtgaaccatgccgccctttgcaaagatcacccgtggaggggttctatttagccggtgactacacaaagcagaagtatttggcttcaatggagggtgctgtcctatctggcaagttttgcgctcaagccattgtacaggtacttgtttttcactttttcttgaaacgatttccgatttgtattaggatattatagtttctttttcttaaatgtcagccatctagcttttatgcatagtcgatgatattttatatgacgcaggattatgagttgcttgctgctcgggagcagacaaaattggctgaggcaaccgttagttaacaatgtaaatactgtttaaggtatagagaaaatcatctgattagtgatcataatacacaattaaagctcaaagaaaccaattcttgtactaataccgttttggttgtataatcatatattttttgccagcatttgctgttttgtgcacatatttgggaacaaaattcagtgaaaccgtgccaatatgtatagggtcgtatacacctatttctcatttaacttccgaaaatttctaacgtgttttgcaagaactataatttggttttaaatttctttaaagttctattagtggttgaaactgaatatttgactctagattattgcacggtatgacaagagtgttatatattatttttgaacttttgagaatcctaatcctttatctatagctttgctaattt

SEQ ID NO: 51 - DNA, 858 bp, Euphorbia heterophylla
ggtaaaactggaactagttattttattttaccaaaatgacttggctgctgctatgctaattacttttggtctatgaaacgaaaagtaatagtggtctgctttttgtctctatacacgtaatttgggcaaataatatgatttcggtcaatgagggtcctaaagtgttttatttcacttgattttgtggtcccttgagcatgcttaatttctaggtttgagatgatgtacaaaaatgtcctcacggttgaatggtatttttggctcactacagtcctcaagcgaattaaatttttactgtttatttaacaaaaagtactaaatcacaatttcttggggcacaggaatattataatccaaaccaatcaatgctggagttggtatttgcacctgcagaagaatggatctcatgcacagacaccgagatcatagatgccacaatgaaagaactcgctaaactctttcccgatgaaatagctgccgaccagagcaaagccaaaattctcaagtatcatgtcgtaaaaactccccggttagtctcctttaaaaaattgcatccttgattagtatctcacatgttttgaaaaccggacccgaccggcccggtcagaccaggttcgactggaaccagccactggcccggtcggttttcagttgattcttaatccagtaaaaaaccagctgttgtccggttataccttaagtccagtttgaccaccgatttggtttaattgaaccttaaacctatgaccgggtctaaaggttctgttcgagatgtgtggtggcatccgacatcggaaataaacaagtgaaaagagtagaatataagtggagtagattggaccttaacacaagccaatt

SEQ ID NO: 52 - DNA, 768 bp, Euphorbia heterophylla
tcaattttgtaaatattttggaaatattgtataattatgataaattcccttttatcttcaggtcggtttacaagactgtcccgaactgtgaaccatgccgccctttgcaaagatcacccgtggaggggttctatttagccggtgactacacaaagcagaagtatttggcttccatggagggtgctgttctatctggcaagttttgtgttcaagccattgtacaggtacttgtttttcttgaaacgacttccgatttgtattaggatattataatttctttttcttaaatgtcagccatctagcttttatgcatagtcaatgatattttatatgacgcaggattatgagttacttgcggctcgggagcagacaaaattggctgaggcaaccgttagttaacaatgtaaatactgtttaaggtatagagaaaatcatctgattagtgatcataatacacaactaaagctcaaagaaaccaattcttgtactaataccgtttttggttgtataatcatatatttattaccagcatttgctattttgtgcacatatatgggaacgaaattcagtgaaaccgtgccaatatgtatagggtcgaatacacctatttctcattgaacttcccaaaatttctaaagtgttctgcaagaactataatttggttttaaatttctttaaagtcctattagtggttgaaactgaatatttgactctagattattgcacggtatgacaagagtgttatatagtttatctatagctttgcta

SEQ ID NO: 53 - DNA, 634 bp, Euphorbia heterophylla
ttgccggtccaggtaaacttgaaattttggataacaaataattctattatttttgtgatccagtgtttctaatactagtatattttcttttatcattagttgatatattgaagcttcttttgcctgataactggaaagagattccttacttcaagaaattggataaattagttggagttcctgtcattaatgttcatatttggtcagtgatgaattcttttatctagtgactgtttatgtgagagttcaaatatcagcacatgattcactaaaataaatctatttctttttcaggtttgatcggaaactaaagaatacatacgatcatctgcttttcagcaggtcctgctcttacgcttttctctagctgttcttcacccatagagatttctacaatcatttttgtaacttttttaaaagctgttatattctgaagggttctgttaggggtacgaaaaccttctttcatgaaggaaatcaattcattacaaatcattttatgtataaattgatttgaatcttgtatgtaaaatgatttcaaatgaatttaggtccttgagaaataatgtttccaaatggaggttaagttgttgctataataagttgacgacctgaatctgatttgtaccactga

SEQ ID NO: 54 - DNA, 399 bp, Euphorbia heterophylla
ttgtgttagatgggctcaaccctacttgtatgctcactcgtcctatcgagcccaacactctccaggcccacggattctctacaggttcaaacaatagtaacgtcacttatcaagcaaattaatttttgcgcctagtgtacctcaagtgcacgctgggcctggcccctttgcatctccaacaactatggttataccttgcggttttcataaaaagcctcaaaatataatttcagctcataccagaaaatatttacaagtttacaaaaataggggtaaaatattgacaaaaatacagtccgctatttttcatatagttttcatctggtgtgctagttttcatatagtttccatatagttttcattaggttttcatccagtttttagaccgtattcatgtaa

SEQ ID NO: 55 - DNA, 283 bp, Euphorbia heterophylla
tttttttgttgtggtaaaatttcccagccctctttctatagggaagttgaacgggattatttttttttttaccgaagaatcaacatgaaatatctccgattttttctttcaaacgatatttatttgttcaatcacttgttttagctcaacattttctcccacttttgtaatattaagcttattttacatttatcaatcaaaatttttattcttttgacatgacatggattatatattaaacacatgtctttttacatatttctctcaaaacgtgatctatact

SEQ ID NO: 56 - DNA, 40 bp, Euphorbia heterophylla
aaattatttatggttggacagtaaatttgtaaatagttta

SEQ ID NO: 57 - DNA, 378 bp, Commelina diffusa
gggtgtaccagacagggtcaatgacgaagtctttattgccatgtctaaggcactcaatttcataaacccagacgagctttccatgcagtgcattttaattgctttaaaccgttttcttcaggaaaagaatggctccaagatggccttcttagatggtaaccctcctgaaagattatgcatgccaattgttgatcatgtccgctccttaggtggtgaggtgcagcttaattcacgtattcagaaaattgaactaaaccctgatggtactgtgaagcacttcctgctgagcaatggaaatatcattacaggagacgtttatgtatttgcagctcctgttgatatattgaagcttcttttgcctcaagaatggagggaaat

SEQ ID NO: 58 - DNA, 383 bp, Commelina diffusa
cgcctgtcatcttagcatcctcataaagtcaagaaattgtgaggacaaatatatttactaactgatggaaacttgatgtttttatcgtggtatccagtatccacttgtgagctgttctgtagattgatatataggaagatatatgacaaacaagatttctatgattttgctaccacttataagcaaagaacaaaagaagtacaatagatatgtatatatatatctctcgcatgcttttctttaaaactataatgggtgtacaatgattatgattttttttgtgtgtgtatgcctacagggtgtaccagacagggtcaatgacgaagtctttattgccatgtctaaggcactcaatttcataaacccagacgagctttccatgc

SEQ ID NO: 59 - DNA, 293 bp, Commelina diffusa
  unsure (1)..(293): unsure at all n locations
taatcgctccatgctagagttagtatttgctcctgctgagcagtggatttcacggtctgatagtgaaataattgaggcaactatgcaagaactagccaagttatttcccgatgagattgctgcggatcagagcaaagccaaaattctgaaatatcatgttgtgaagacaccaaggtagatcacctttgtctctttnccagcacttttcattttggtcctttggatatttaaatcttgcagagaaaggggaagggtagataataaataattagcctacttactgccatagcaca

SEQ ID NO: 60 - DNA, 284 bp, Commelina diffusa
cctattgggccgttcactggtctattgttgaaacagttgatatattgaagcttcttttgcctcaagaatggagggaaattccctactttaagaagctggaaaagctagtgggagttccagtgattaatgtccatatatggtgagtcattttttctctagcaatttctgctacttcttagtgacagtccctcatataaatgaatagtatatgatttatttatatatttcttatgatgttcttatttttaagcttaattgtttgtatacatgggttgagatacttc

SEQ ID NO: 61 - DNA, 458 bp, Digitaria sanguinalis
aaagaagccaaaaacaatctcaacccaacaacatcttcttcttcttctaataataagtacctgcaaggtcatgtctctacttggaaattctatagtaaccacccatgtactgtcctttagtcacgctgatattatgggtgctcatcggttgcaattcccggctgtccgatcaagaaccaccactaccaagaatgtctgccctttcaaggtgctctgcctggattatccaagaccagaccttgacaacacttctaacttcctggaagctgcctacttgtcttctaccttccgcacttcccctcctccagctaaacccttaaacgttgtaattgctggtgcaggtttggctggtctatccactgctaagtatttggctgatgccggtcacaagccccttttgcttgaagcaagagacgttcttggtggtaaggtagccgcttggaaagatgatgatggag

SEQ ID NO: 62 - DNA, 7350 bp, Digitaria sanguinalis
tttctttgattttctatgattttctaaagttttggagaaaaaactttggccatctatgattttccattttctatgattttttttattttctatgattttctaaagtttctatgattttctaaagttttggacaaaaatatttatggaggacatttgataagacatctatctataaagcccactttgacccatttaactaggataagtagaaataagaccaattaaagaatatttacttatacatgttcaacattttttgttaaacaagttcaacatttgataatgaaatgtcgacattgattaacctaaatgttgcaattggagaacagcaatattgaaatcaaagggccggaatgttgaatgctcaaatcataaatgttgaatgctaacatcaccaatgatgaactttatctcgtcttctccgggcacggcggagcagcagcggcgtctaggccaggccgcgcgacagagcagtggcggcctaggccagggcgcatgcatggatagcgggagcggcggcggcgccggtgtggagcaggccatggtgcgatcagacttggccccatgagagggctccgacactgtgcgggtttggtcggtggtgggtgtggcaggatgacccgaggcttcctacataatttctatccatctgtgataagattttaatttctacatatttaatgtttgagatccgtataaataattacaactcttaaatctacacctctcaaaccctatctccctttctaatcccctgctccctctctcctacactacacctgccgcccaccgtgttaccaaatacgatacacttaaataggtgtatttacaatttatttgaaaatataaatagatagagtatataaatatctataattatgcaaaatttaaagtttaacaaaaatttgtgcaaagagataaaaaaaaggaaaactcaacactaaatagttgcagattgcgggtttccaatgaaaagtaaagcacacaactatttatgtgttggtttctctttttcatatctccttgcacaattttttgttcaaccagaaactttgcatgacgagagatgtttataagctttatccatctatacttttagatgaattttagacgcaccgatttagtgtgctaccgtgtttggtaacacagtaacatttaaaatcctctgtcccaaaatttaagcattaattaaatatatatgctaaagttcctcatgccttgtggcctcatgtgggacctacgtactgtttatgtgggacccacgtgttatttaggtgagccctatgtaggacccacgtgctatttatgtgggacccacgtgccatttaggtgggacccacacactatttagagtgggacacactctctttggtggggcctgcttagtgggacccacaacaatattaagtgtctatgttaaaaattatcgaggattgtttttccattctttgcggtataaatatatttatttttctatgtataaaaataatatctaactttgtatactacattcatttgtgatagttctaatattttttctactttgctttaagatcataaatttggaaaataagatcgaattatacattcattactaaatttatctttccttctataaaaatttaaaaattagtgtaacataacacgtcacttcattagctatttctattaccacttagaaaaaagttatatagctcttaaatgatcattataattaaaaaatatgtaaacttaatattgcaattgagtatagtaagatgataaatttgtattgagtttaacattttttatatagatgagcatggcgcgtcaacctgactagtatgttattagatttcccaattataacatttttaataaatttagacacttattctacttatctaggttcaccgaagattctataaatttagtgaaaggctagaaatatttatatattttgtaagggagggagtagacggagatggcaggttacacaatgaacgagctgccacgttgactcaaatagttgccacgtgttatctagtttctttaaaaagaaagcaccaagagaaaataagagagatgacgtggcggtatataccgcggagacgtagagcgcaccaggcgccaaaaggcatcctcctcctccacatcctcctcaccccgcgctcgtcgtgctcttgtccctttccaccgccccaaccaagtcaagtgcggaggaggccgcccgcctccccttatcatcgcgcgacacggcttcctccccacctgggctcctccgcctccacgccgctccccgctgccccgcctcccctagtccctccctcctcctcatccggtaagtcctcgttgcctgctcacgctgcgtttccatttaatcacgcgggagtcaggtcaggcgggattcggttcccatggggatgggggcggctctcgtggtacctgcgaccggaaattattaacgggctatatagaaatgggggatttcttagggtttgtgctttgaaggcattggaaaattgtgactggtttggggaattggcagttacaacttacatggagtagtctgcagttgttgggcacagagttttagcggtgttctggtagtgtttatagagtatggcacacattgtatagtatagggagacttttggttcaaatttaatattagacggtcatgctacaaaatgggaggtccaagttgtgtattctgtttcctttgcatcattgttaactcactgcttgttctcagcatagaataactaaatcaatgtgtaccaaccttgatcagtttacttacatacttggaagatgcgcgtaagaaatgatctcatgaactgccagtctaatagctcctcttggttatgcagtagtctgcctctgcgtattggttaatcagagctgacaacaatcaccaaaagttgcttcgacatggatactggctgcctgtcatctatgaacatttctggagtgaaccaaacgagatcttttgcgggacagcttcctactcagagatgcttttcaagtagtcacaacgcgagctttgctgtgaaatctctagttgtaaggaataaaggaagaaggtcacaccgtagacattctgctttgcaggttcagttttttgttcattttcttctccaattttcaggtcatttcttagtgaaaatatgattgattagcttttctgcagattgtctgcaaggatttcccaagacctccactagaaaacacaataaactatttggaagctggacaactctcttcattttttagaagcagccaacgccccagtaaaccattacaggtcgtgattgctggcgcaggtccgacgtgatttgtgattaatgttttcacaaatctttttgtcagttacttccagggtaataacagttgagttttagctttattaatttgtggtgtaacttttgcaggattggctggtctatcaacggcgaaatatctggcagacgctggtcataaacccatattgctcgaggcaagagatgttttgggtggaaaggtctgaaagatacttacatgattgtttacaatgctcttaattgctcgcatccggtgttttcatcgtttgttcctttaatgattttttttttgtttttttgtttatgcactgaacagatagctgcttggaaggatgaagatggagactggtatgagactgggcttcatatcttttgtaagttacagtttctggtccttaaggttgtcttcatgatattttattttctagattatttctattagaaacatacatttaatgtagacatgttaacaagctgttaaggcgcaccagcacacaaacttctaaagcacagttgtctatcgtgcttgtttatttcctttaaggaatatctgttttagtttgcaaaattattattgagaaaggagtttttttttaaattactaatagcgtgaaaatagcatggaaagtttgcaggctactaaaaaagcgtacatcagtgcatgttttaatgttacgtaaacgtgttgtatactccttattatccataatggcatagttgaatatctgttattctgttcacaagaacattcgattgctaccattcccttcatagcttatataacactgcgtgtatgtaaccatgcatttttgttttaagttggagcttatcccaacatacagaatttgtttggcgagcttggtattgaggaccgtttacaatggaaagaacactccatgatatttgccatgccgaacaagccaggagaattcagccggtttgatttcccagaaactttgccagcacctgtaaatggtacgactatgcgattttggagttgttgcaactgatttcctagataatccagaaatacattctaatcttagtctactcattttgcttatggacagcattaacgcttccaattgatgctgtactatgattcaccactgtacttttaacaggaatttgggccatactgagaaataatgaaatgcttacctggccggaaaaggtgaagtttgctattgggcttcttccagccatggtcggcggtcaaccttatgttgaagctcaagatggcttaacagtttcagagtggatgaaaaagcaggtacgaattcaatttgtcgattagactagtctctgtgtaacagaaatactgccatctcatcagtactagagagcttttagtttaccaatagattgtttccttttattttcttatcttcctgaagaagtacaggtagctccataaaatgctttatatgctcaaattcttaacttatatttggtgtaaatctttttctgtgaaaattaagacagagcaatgcttatagatgcattaacttggccagttaaaggccagcaatgttcatcatgttaagttcagcaatgtaccaaaaaaatgaaaaaaaaaaaacacacaagagacataatggtttcttgctaactgatacacatgccgttttcttcaaaaattggtttcacctttgtcgtttggaatacagatggtaatatatctttctatttttctgtggagatatgtggtgcctgatacaattatttgatcagcacagggtgttcctgaccgagtgaatgatgaggtttttattgcaatgtccaaggcactcaatttcataaatcctgatgagctatccatgcagtgcattttgattgctttgaaccgatttcttcaggtacatctgttgttgctctatgttattgtgtaatatattacttgcctgttctgtttggagaaatagcttacatatgttgattcttgctttcttgtctgtactctgtattatttttgaactgagagagatgccaatatgtatttgcatgtgggtattttgtgtaaacgtgcaggagaagcatggctcaaaaatggcattcttggatggtaatccacctgaaaggctgtgcatgcctattgttgatcacattcggtctaggggtggtgaagttcgcctgaattctcgtattaaaaagatagagctgaatcctgatggaactgtaaaacattttgcacttaccgacggaactcaaataactggagatgcttatgtttgtgctacaccaggtgtgatttattaccagtaaaccttgtttcctgtgcagctatactgctatacaactgaagtactgaactgacaagtctttgtatttagttgatatcttcaagcttcttgtacctcaagagtggagtgaaatatcttatttcaagaagctggagaagttggtgggagttcctgttatcaatgttcatatatggttagttaattgaaatatttggttctgaattggaaatgctccatttccttatatggttatgcttcttccttgaggcatttctgaagctttgctgagaactgttgttttgaatgcctcaggtttgacagaaaactaaaaaacacatatgaccaccttcttttcagcaggtacatcttctggccatattcttagttcatgcattttttgtgcaatatttcttgattcatgcactgttcaggttgtgcacatttactgttgatggtattaaataccatatggcccttgttgatcttgtcagtaacctgcattttttttcaggagttcactgttaagtgtttatgcagacatgtcagtaacctgcaaggtaccgactatcatcttcagggcaatatcagttttgttcaaacactagcatactaatacattggccatgatttcttcattaattctagaggctcagtgacctttacatgcgtcatctacataaacggtcctagggctcagatgattaagaaagaattcattataagtggaaatataaatatcttgcacattaaaaattttggacatctgtgctagatgtattgaagtgtgtgactttgtcattgcttacatgtcagtggtcactgtgttgtattgatgaatcatgatatgttaaatagcgaaggacatgattgcagattgcacactcaccttttttctttccttttgttgtctaattctttacaggaatactatgatccaaaccgttcaatgttggagttggtctttgctcctgcagaggaatggattggacgaagtgaaactgaaatcattgatgcaactatggaagagctagccaagttatttcctgatgaaattgctgccgatcagagtaaagcaaagatccttaagtatcatgttgtcaagacaccaaggtgaggatatttgtcggacacttctgatagataagcaagtagctctagctctgacagttttttgtgttgtttccttttgttcatattctggcttgctttgacagatcggtttacaaaactgttccaaactgtgaaccttgtcgacctcttcaaaggtcaccgatcgaagggttctatttggctggtgattacacaaagcagaaatacttggcttccatggaaggtgcagtattatctgggaagctttgcgcccaatctatagtgcaggtaaatacacgccatgttccttgctgtacataaaagcatcggattgcttataagtttgatcgtttcgatgtgatacatttttgcagctaattatttaacatctgctgctttcaggattatggcaggctctccctcaggagccagaaaagcctgcaatccgaagaagttcctgtcgcatcttaggcatagttcaggctcccatttggtgtgtcatcttatcacctatttcgtgggaacccaccaactgctcatgttgagggacctgacctcttgtgcccctctgacaattccctagagctgaaatgtgacagtagttgatatcatattgggaaacaggtgatatatatgtaaaacgacctgcatagcaattcttagacctttgcaaaaggaaaagcgaaaaaagatatctcagatagatattatcttgt

SEQ ID NO: 63 - DNA, 2640 bp, Digitaria sanguinalis
gtctgaaagatacttgcgtgattgtttgcaatactctggtccttttcatcgtttgctccttttataattagttttttcgtttatgcactgaacagatagctgcttggaaggatgaagatggagattggtatgagaccgggcttcatatcttttgtaagttacagtttctggtccttgaggttctcttaatgatatttgattttctagattatctctattagaaacatgcatttaacgaagacatgttaacaaactgttgaggcataccagcacacaaacttctaaaccacagttgtgtctatcgtgcttgtttatttttttttatggaatatctgttttattttgcaaaatcatgattgagagaggagttttgttaaattacttagtgtcaaaatagcctgaaaagtttgcaggctactaaagcatacatcatttcatgtttcaatcatgttgtatactccatagtatccataatggcatagctgaatatatgttattctgttcacaagagcattcgattgctaccatccctttatgtaacaatgcattttttgttttaagttggagcttatcccaacatacagaatttgtttggcgagcttggtattgaggaccgtttgcaatggaaagaacattctatgatatttgccatgccgaacaagccaggagaattcagccggtttgatttcccagaaactttgcccgcacctgtaaatggtatgattatacacgatgttgaagtcgttgcaacagatttcatagagaatccagaaatgcattgcttcaggctggggctgtgtccctaaaactctaaaagaaaatgcagaaatgcattctaatcttagtccactcatttttttctaatatatgacagcattagagggtttattagtggcagtagtaacactacatgattaccattcagcttacacttccaattcatgttgtacttatgatttaccattgtacttttaacaggaatttgggccatactgagaaataatgaaatgcttacctggccagagaaggtgaagtttgctattgggcttcttccagcaatggttggtggtcaaccttatgttgaagctcaagatggctttacggtttcagaatggatgaaaaaacaggtacgagttcaatttgttggttagacttatctccatgtacaagaaatactgccatctcatcaatactagagagcctttagtttgccaaaagattgtttccttggcttttcttatcttcctgaagtacaggtagatgaaaatgcttcatatgctcaaattcttatcttacatttggtgtaaatctctttctgcaaaaatttagacaaggctgctcatagacttgttaactttgccagttaaagtccagcaatgttcatctgtaaattcagcactgtaacaaaaaatggggaaaaaaaggacgagcacataagagtttcttgctaactgatgtacataagcagcgttcttcaaattttggtttcacctttgtaatttggaatacagatggtaatatatctttctatttttttatggagccatttggtgcctgatacaattatttgatcagcacagggtgttcctgatcgagtgaatgatgaggtttttattgcaatgtccaaggcactcaatttcataaatcctgatgagctatccatgcagtgcattttgattgctttgaaccgatttcttcaggtacatctgttgttgctctatgtgattgtgtaatacgtatactacttctgtttgaagaaatagtttacatatgttgattcttgctttcttttatgtattatttagttacctgagaaggttgctaatacgtatttgcatgtgggtattttgaaaagtttattttgtgtatacgtgcaggagaagcatggttcaaaaatggcattcttggatggtaatccacctgaaaggctgtgcctgcctattgttgatcacattcggtctaggggcggtgaggtccgcctgaattctcgtattaaaaagatagagctgaatcctgatggaactgtaaaacattttgcacttaccgatgggactcaaataactggagatgcttatgtttgtgctacaccaggtgtgatttattaccagtaaaccttgtttcctgacttcctgtgcagctatgcaactgaactgactagtcttcgtatttagttgatatcttcaagcttcttgtacctcaagagtggagtgaaatttcttatttcaagaagctggagaagctggtgggagttcctgttatcaatgttcatatatggttagttgatcgaaatatttggttctgaattagaaatgcttcatttcctcgtatggttatgcttcttccttgaggcatttctgaagcttttctgagaacttctgttgttttgaatacctcaggtttgatagaaaactgaaaaatacgtatgaccaccttcttttcagcaggtattctcctgggcatatttgtagttcatgcatttttttgtgcactatatcttaattataattgtatcaagatatttcatgcgttgttcaggttgcgcacattctactgttcatgtacgaatgctcattttcggtattaaatgccatgtgtttattattattttttcaggagttcactgctaagtgtctatgcaga

SEQ ID NO: 64 - DNA, 1012 bp, Digitaria sanguinalis
caatgactttcacatgtgccctatacataaaaggtcctacggctcacatgattaagaaggaattcattattaagtggaaatataaatatctttcgcattaaaaattttgatatctgtgctagatgtattgaagtgtgggactttgtcattgcgaacatgtcagtagtcactgtgttgtattgaagaatcatgatatattaggtagcgatggaaatatgcacactcaccttttttctttccttttgttgtgtaaccctctacaggaatactatgatccaaaccgttcaatgctggagttggtctttgctcctgcagaggaatggattggacgaagtgaaactgaaattattgatgcaactatggaagagctagccaagttatttcctgatgaaattgctgccgatcagagtaaagcaaagatcattaagtatcatgttgtgaagacaccgaggtgaggttatttgtcagacactcctgatagataagcataagtagctctagctctgatagttttagtttagtgtttttttttgtgtgtgtgtgtgtgtgtgttgtttccttatgttcatactctgccttgctttgacagatcggtttacaaaactgttccaaactgtgaaccttgccgacctctccaaaggtcaccgattgaagggttctatttggctggtgattacacaaagcagaaatacttggcctccatggaaggtgcagtactatctgggaagctttgcgcccaatctatagtgcaggtaaacactcgccacatgttcttggttgtacataaaagcatcagattgcttgtaagtttgatcattttgatgtggtacattttggcagctaatgatttaacatctgctgctttcaggattatagcaggctctccctcaggagccagaaaagcctgcaatccgaagaagttcctgtcgcatcttaggcgtagttcaggctcccattcggtgtgtcatcttatcacctatttcgtgggaacccaccaactgctcatgttgag

SEQ ID NO: 65 - DNA, 1995 bp, Kochia scoparia
atgagttattttggatatgcttgtgctacccaatccacttcaagatgtgttcttttgggcaattctggtaaccccacttcagtttcatctcgtggcagtgatttcatgggtcattctgtaagaaatttcagttttagcaaaagacagagaattgggcactgcccattgaaggttgtttgtgtagattatccaagaccagagcttgaaggtacagtcaattacttggaagctgcttatttatcttcaacttttcggaattcacctcgtcctcaaaagccgttagaggttgtaattgccggtgcaggagggaaaagggtagtgataattactgggtgtttggctaaggatgttcagcatagcatggttgtctcttacaaccacactcatgtattaccatggaccccctttggagagggtaaggtggttttaattgtatccataggttttcaaagggtgacaagtggagggaaatggttaccttcaggaaatgagggaacagggagttgggtccttgccttcatgggaaaagagagattgttaggtttggctggtctatccacagcgaagtacttggcagatgcaggacacaaacccatattgcttgaggcacgagatgttttgggtggaaagctgttgaagttattcatcattctgtacaatgttaagtcagtgttaatgaggtttagaggggttgcagcgtggaaagatgaggatggtgactggtatgaaactgggctccatatattctttggggcttatccaaatgtgcagaacttgtttggagaacttggtatcaatgaccgattgcaatggaaggaacattctatgatttttgcaaggcctgacaaaccgggtgaatttagccgctttgattttcctgaagccctgcctgcacctttaaatggcatatgggcaatcttaaggaataatgaaatgctaacatggccagagaaaatcaagtttgctattggtctcttacctgctatggctggtggacagtcctatgtcgaggcacaagatggtttaagtgttcaagagtggatgaaaaaacaaggtgtgcctgatcgtgttacagatgaagtattcattgccatgtcaaaggcacttaacttcataaatccggatgaactttcgatgcagtgtatcttgattgctctgaatcgatttcttcaggaaaagcatggttcaaaaatggctttcttggatggaaatcctccagaaaggttatgcatgcctattgttgagcatattgagtcactaggtggtgaagtgcagcttaactctcgtattcaaaagataaagttaactcaagatggaagtgtggatagcttcttgctaaccaatgggaaagaagttagaggggatgcttacgtctttgctactccagttgacatcctaaagctacttcttcctgaagagtggaaagaaatttcatacttcaaaaagttggagaaactagtaggagttcctgtcattaatgttcacatatggtttgataggaaattgaagaatacatatgaccacctactcttcagcaggagtcctcttttgagtgtctatgctgatatgtcagagacatgcaaggaatattatgatccaaaccggtccatgctggaattggtttttgcacctgcagaagaatgggtttctcggagtgacacggacattattgaggcaacaatgaacgaacttgccaagctttttcctgatgaaatcgcagctgatgggagcaaggctaagatcctaaaatatcatgtagtcaaaactcccaggtctgtttataagacagttccaaactgtgaaccttgtcgaccattgcaaaggtcaccaatagaaggtttctatttatccggtgattacacaaagcaaaaatatttggcttcaatggaaggtgctgtcctgtctgggaagttttgtgcacaggctattgtacaggattatgatatgcttgttgctcgagcacaaagagaattggcaggggcaggcaacgcctga

SEQ ID NO: 66 - DNA, 1971 bp, Kochia scoparia
atgagtcattttggatatgcttgtgctacccaatccacttcaagatgtgttcttttgggcaattctggtaaccccacttcagtttcatctcgtggcagtgatttcatgggtcattctgtaagaaatttcagttttagcaaaagacagagaattgggcactgcccattgaaggttgtttgtgtagattatccaagaccagagcttgaaggtacagtcaattacttggaagctgcttatttatcttcaacttttcggaattcacctcgtcctcaaaagccgttagaggttgtaattgccggtgcaggagggaaaagggtagtgataattactgggtgtttggctaaggatgttcagcatagcatggttgtctcttacaaccacactcatgtattaccatggaccccctttggagagggtaaggtggttttaattgtatccataggttttcaaagggtgacaagtggagggaaatggttaccttcaggaaatgagggaacagggagttgggtccttgccttcatgggaaaagagagattgttaggtttggctggtctatccacagcgaagtacttggcagatgcaggacacaaacccatattgcttgaggcacgagatgttttgggtggaaagctgttgaagttattcatcattctgtacaatgttaagtcagtgttaatgaggtttagagggttgcagcgtggaaagatgaggatggtgactggtatgaaactgggctccatatattctaacttgtttggagaacttggtatcaatgaccgattgcaatggaaggaacattctatgatttttgcaaggcctgacaaaccgggtgaatttagccgctttgattttcctgaagccctgcctgcacctttaaatggcatatgggcaatcttaaggaataatgaaatgctaacatggccagagaaaatcaagtttgctattggtctcttacctgctatggctggtggacagtcctatgtcgaggcacaagatggtttaagtgttcaagagtggatgaaaaaacaaggtgtgcctgatcgtgttacagatgaagtattcattgccatgtcaaaggcacttaacttcataaatccggatgaactttcgatgcagtgtatcttgattgctctgaatcgatttcttcaggaaaagcatggttcaaaaatggctttcttggatggaaatcctccagaaaggttatgcatgcctattgttgagcatattgagtcactaggtggtgaagtgcagcttaactctcgtattcaaaagataaagttaactcaagatggaagtgtggatagcttcttgctaaccaatgggaaagaagttagaggggatgcttacgtctttgctactccagttgacatcctaaagctacttcttcctgaagagtggaaagaaatttcatacttcaaaaagttggagaaactagtaggagttcctgtcattaatgttcacatatggtttgataggaaattgaagaatacatatgaccacctactcttcagcaggagtcctcttttgagtgtctatgctgatatgtcagagacatgcaaggaatattatgatccaaaccggtccatgctggaattggtttttgcacctgcagaagaatgggtttctcggagtgacacggacattattgaggcaacaatgaacgaacttgccaagctttttcctgatgaaatcgcagctgatgggagcaaggctaagatcctaaaatatcatgtagtcaaaactcccaggtctgtttataagacagttccaaactgtgaaccttgtcgaccattgcaaaggtcaccaatagaaggtttctatttatccggtgattacacaaagcaaaaatatttggcttcaatggaaggtgctgtcctgtctgggaagttttgtgcacaggctattgtacaggattatgatatgcttgttgctcgagcacaaagagaattggcaggggcaggcaacgcctga

SEQ ID NO: 67 - DNA, 12119 bp, Kochia scoparia
aggaaaatctagatgaaatcacaaaacaaaacccactaaactatacttatcctagaaaagtaaaagcattcaattagtgatgagaagcttaagcatacgctgcacaaaaacaaccaactaatcaactcatagaaaacagcaactgatgtcagtaagtagtttctaaaattttaccttccttgcaagagatgaccaagcccaactgtcccgaacacggtcagggaaatgagaggaaggccatatctcataaatgggttccttctccccaatctctttaatcctgaatactgaaagcctggaaaagcagcagctttctttgaatcattaactggcgctctcgcaacgactgtcatgtttctccctctaaatatgactctgaagttccaatttcactcagaaattagttgttcaacttagcaatcaaacaaatttaactaatttgtagcttaaacacttgtaagaacaacatctggaaaacccacatcaagttttgttcaacgaaagcaccataattgatccataaaccaagaaaactggcaaattcatactcctcatcaaacatttcgacattcatagtttcaaaaagtagaatgataattttagaaagtcgtttatacttcaaaattgcaaagaataagacgcataacgtactgtatccataaacgattgaaaaaaaataattcatgcttttgattgatattctgtgccttgtaaaaatatctgtaatagcgcaattaattgacacttgcaaaagctcaaatcaaaacgctaaagttaaatcacaaatagcaactaatcaaattcataatttgtcgaaagtatgaatgaggttaaagttacacaaaatacctgaaaatggcgaaaataatgcggaaaaatctttattcttctttagctcgttcttcttctgcaagaagcaaacttgattttaggatatgctaatttcgcaaaccagaatttagggttcgtttggtagggcgtaaaacgttttcaaatgaaaatagttttcattgaaaaacattttacaattgaaaactcattttcatacaagttttctattgtttggttgaatggaaaatgatacaaaaggtttattgttttatttttattatcaaaaatatttttttaaaaaataaaatcaaaatccagattgattaataaattaaaacgtcgaataatgtagcaaatagtgttattgatatcaatcaatcatgattttgatgaaaatacaatcaagaattcttaagcaaaatcttgatgcgcgtccacaacatccgaaaaataaacattaatttggtttatcaggatgatttccagaaatttatggaaaatcgaaaatttcaaaatcatccaaaaattcgcgtcaacttttatcaataatcaaacatcaaaattcaatcaattacctatgtagttgaaatatcaatctatccaataatccagcaataatacaataatcaaatactgaaattccagaaaaaaacattcatcttgtcatcttgattgctgctaccatatcttcattagatcttcttccccaattgattattaaaccaaatgaattatttaggatttttgaaatatttgaattgattgtaaaaattgaaagaaattcgagaccggcaaagaattgaagaagatggaaattcgaggcaaagaattgaagaattgaagaattgaagaattgaagtgaagttgttgaaattgaattgtactgtgcgaattcaaaagagagttatgatagagaaagtgtagatgttagatgtcgtatgatggcagaagaaagtacgaaacaaaggaaaaccttttcctttgatttttgaaggaaaagattttcaattggaatgtaaaataattttacactcaagttttccattttattttttcaatcttaccaaacaatgtaaaataggaaaatagttttcagggaaaatgttttacgccctaccaaacactaccttaatcttggcggttgagagatttcatctcaataattaaaagtataaaatccaagaagaaaagattaccaaaaaacttggagaaagaaattgattaagagatgatgagatatggcagtaccgcgattaccgaacaaagattgaaatgatgatgagatgatgatgatgatgatgattgatgatgatgatgatgaattgatgatgagctagctcgaaaacggatttgtgcgggtaatggctcaaacgattctgaagactacgttattcatccattttggtcgctagtgggcatgacttgagtaaaatggattgaagtgacggctagattggatttggggctagccaagacataagaatcgtttgggttaatcgttaaccgttaagagtgggtcgagactaatataggagcaacttttcgttcgaaacccaaaaaaaaaaaaacaaaacaaagcacatgatgaatactgaataaaaaaataattaattggatccatcttatatgcctaaggcgtacccaaaagtcatgaaggttggctgatcctatctacggaatacacaatgcttaaacaattaaaattaacatactttgtaggtgaggcatgcttggtttgatcaaatttagacatgagtgacgaattgaatcttgcctaataggatcaaactcatgaagttatgatatgacatgcactatggattattttttgcatgagatttttataaaacttgatataatctacctaactaatgtatgtcctgattgacatttgagttgtccaataacgtaccacgacatcaattcaagagttcttcgaagaaaataagtaaataaccccaatctcaaggataaggagatttgaaggctaaaaaaacttgatctacccattgagtagactacccaccattaattgacagtggtaaaaagtggtgacaatagaattacactcaagttatgaaacaatagatatgtatatgcgatccattaagtaaatgtaatcatgtccgagccgaagggatcaagcctagacaccagtcaagcttgggttggtaaaatggtgaagtacttcgtatgtattgaagtattgtaagtacatgagtaaccgcaaaggctctaaagctactactactactactcctaattgggtaaccgcaatatgtgtggacagttcgaaagccacacaatttgagtggcattttccatttttcaattctcctctctctctctctcagtggctcaaacagaaatcgcattacacccacattccacaaatggccctttgataaagcactaaacctactctactcctacactccttcatctaatctcaatttccgttacttctttggttctattgcacacccttttacacccattgcagtttatattccactgaatttcgtattgcaaacccaatttacaaaaattgcagaagaaaatgagttattttggatatgcttgtgctacccaatccacttcaagatgtgttcttttgggcaattctggtaaccccacttcagtttcatctcgtggcagtgatttcatgggtcattctgtaagaaatttcagttttagcaaaagacagagaattgggcactgcccattgaaggttctattgcttgctttcttgtttatggatcaattttatgggatttgatgaaaagattagattttgtttatagttgaattaatcgagaattttaatgtatgatgcaggttgtttgtgtagattatccaagaccagagcttgaaggtacagtcaattacttggaagctgcttatttatcttcaacttttcggaattcacctcgtcctcaaaagccgttagaggttgtaattgccggtgcaggtaagtgggatgtttcctgtaacttgctttgttcattagtttcttgttcttttgcttgttgctttataaactagtgatgtttggtatgtgtttggtgtaatcattgtcttactgatatggaaaggattatgtaggagggaaaagggtagtgataattactgggtgtttggctaaggatgttcagcatagcatggttgtctcttacaaccacactcatgtattaccatggtaagggttgtacttagaaaattgttgtatttggcaattggcaatacaatggaattgaaccatatttcatgaaggaccccctttggagagggtaaggtggttttaattgtatccataggttttcaaagggtgacaagtggagggaaatggttaccttcaggaaatgaggtttgttcctacacttacaccaaatggtgtgcaattacaccttaaaatccattaccaaacacccttaggtttcggtttatcatctgttagaggcctaccaatgagaatttcccttacgttaatgaagtaatgggttttgacaccttttttttttatgttgcatgttcgaaataagctttgtagtttgaagtagcttacggctaatagctgttatgcgggaatattgtgaattggaaaaagaataagagagtacttgcttcaaggatcataaggtttatgattgttggaatcatctttagtgaaattttgattttcaactgatctctacggtaactattggtccttcaaaattctagacgcagaatcgtttaggtgagggtgaactctgattatgaatagtcaatgtctctcccaacgtgaaacttattagttctagctgttatgtgctccaattcgaggaacatcgtgaattggagaaagaatactgcttcaaggatcatgagtttatgattgtcgtaaacttctcttagttctttagtgaaatttcagcagattttaatggtaattagcagtccttcaaaatcctagatgcggaatcatctagggcatgtatatggtaaactctcatgatagataactagtgtctcctccatgtaaactttattaggtattttctttgtcaaaaagagtatttttcattggaaaaacaatataatggtgactactgcatatgtttggttagctattcctgttgcaaatcagattttgaatggaacatgtcttattcccttctagagctctcctggtgcaattctagcattttcccctcaataagtggtatttgagctaatatttcaagtctagacattatagcatgctataatgaggcggaattgtttgagccatgttaaagggttccatgacatgtaatatgctagtttatggcagggaacagggagttgggtccttgccttcatgggaaaagagagattgttaggtatttcttaagtttgcatgggaaagagttcttttatctttatagtgaaagttgactagtatgcaagtatggtggtggattacccttattgccatttggacttgtatgctatttagtgcatatacttcagcctagcttaatcttgacaaaaatgccttgagttctagtggtttgctttattcattggttgatttgctatttctgctagtgaaattagagagaaaattgatgcctgtttcagtgtttctcatcaaggtaaatggacaaaactgtctatgtcttgaaattttctgtgaatactcaagcaggcttccttggtttgcttcaggctgattttcattgcctcagtttctgcttgttggtatcagaataaaaatagatacttttatgtatttgtgagagatttgttggtagaaccacatttattctgagaaatatttgtacaaatgggagtttaaggttataagtgtgtaagccttttgaggtattttgttttaaaaatcttatcgttatttcagagcagcaagttacatatagtaaacttgggagcattggagatgtgatggaattagattcaatatattttatcatcaagatatgagttctaattcaaaactttccttctaggtttggctggtctatccacagcgaagtacttggcagatgcaggacacaaacccatattgcttgaggcacgagatgttttgggtggaaaggtatgtgcttatatgctattttttcagaaatatatcctttgtgcttcttctcttctcagtttatgttgactataataaatgaaacagcttaattgtcttggttgtatgctttcatagtattatctaggctacatggttatacggacatatattattgagtggagtgatttagtcatcttaagtggttatttacttttattttatagctgttgaagttattcatcattctgtacaatgttaagtcagtgttaatgaggtttagagggtaatggactaatagacaagctttgtgctgtgaacggtttgagaacatgtgctattgggactgatgttatgcaatgtttgtggtagtcttccttcttatgcatttgtttattgttactgtttcacagggttgcagcgtggaaagatgaggatggtgactggtatgaaactgggctccatatattctgtgagtataatattttgcttttcagcttagatatcctgtttaagcttctagtcctacaatttatgttttctgctgagtggatttttgtaaaagttttacgggatctgtgcaatttctgccttctgattctgttattatttggaagggcgtgatattgtgacaatttcaaagtggtttcactccagacaaaagtcaaactaacaattcaatgtactgaatacccttttattttcttgaagttggggcttatccaaatgtgcagaacttgtttggagaacttggtatcaatgaccgattgcaatggaaggaacattctatgatttttgcaaggcctgacaaaccgggtgaatttagccgctttgattttcctgaagccctgcctgcacctttaaatggtgagtatttgacaccttatattctttagcaaactaagtattgtataagccaaactgcacctggtgacattcattgatttctttcttgctcaccgactttccttgagattctagcaacatcttattctccgtcttctaatgagtaaactagttttgattctgttcattcttaatgtgtttggcaggcatatgggcaatcttaaggaataatgaaatgctaacatggccagagaaaatcaagtttgctattggtctcttacctgctatggctggtggacagtcctatgtcgaggcacaagatggtttaagtgttcaagagtggatgaaaaaacaagtaggaacaaacgatcatttttaaaaccttatttttcaaattccttgatgattgtctagattgttagttcattacatgtctaactttaaacattgatgttacagggacatctattttatttatttttgaaaattccttttgcaaattttgtagggtgtgcctgatcgtgttacagatgaagtattcattgccatgtcaaaggcacttaacttcataaatccggatgaactttcgatgcagtgtatcttgattgctctgaatcgatttcttcaggtatagccccatttcactatctgctttaagtgtgttttattttcaattgaattcgacctgctcaactatatggaacttaagtaattttgatttgaacttattgatacaaacgtatcaaaacttacgataatctttttcagtttgatacactatcgttttgtttctgagaactttttgtaaattggattatatgtgatgttaaaattatggaattcactcaacaggaaaagcatggttcaaaaatggctttcttggatggaaatcctccagaaaggttatgcatgcctattgttgagcatattgagtcactaggtggtgaagtgcagcttaactctcgtattcaaaagataaagttaactcaagatggaagtgtggatagcttcttgctaaccaatgggaaagaagttagaggggatgcttacgtctttgctactccaggtttacttttcttctttaccgaatgggattattattcaactaggaaattattgccatttttagtcaagacaggctcctgaagaaattatttattgccatctgtattgttctctgatatacctttaaatttttattacagttgacatcctaaagctacttcttcctgaagagtggaaagaaatttcatacttcaaaaagttggagaaactagtaggagttcctgtcattaatgttcacatatggttagtgatacctcttgtctacaggaatatagtttcttaatgctataacccaatcttatgtgtcttctcttactctatgtaattttatttatgtatctatctttctctttccatgtccatgtattttgttatttctgtctttggctttttagaatggtttgtcagtatatctttgcaattaggctctgatttaatagcctactactatacgaagtatatcatttctttggtagtatattttctgtagtttgcgttgagagtttgagactcctatacgtagagcttcatcttaataaaattttatgtcttgtaaaatctgtctgttttgaaatgtcaaaaaagctgtcaaaagctatttctcaccctctccttatgaagaacttcaatgaaatctcctctaatattgggactgacatttaacaactgttggcttgcaggtttgataggaaattgaagaatacatatgaccacctactcttcagcaggtgtgttcaattaaagtgctaaattcaatatcattttcatagcactcaaacaatactcaaagattatccttccctttttgtccttgttttatactcatttcgttttccctttttttgttggaaagcacattttgttgagcatatgccatgagctgcatacttgcataaaattgggcaaaggagccacagtcatttgatatgaagtatgatttaagaatcctcctatgaagttagaaaagttatggtactagttttcttttactgagtgaacggggtatccctgccagcaatgtgtacaaggatactggcttgctgcagaaagatactttcagtattgataagatacaaattgcatttttcttttggatgaaatacagtgaactggcaatggtgtcagcttgaacgttgagaatccttgatatccatttgattcatgttttcacttgtgcgtggatttcactcctataagtttgtcattgcaggagtcctcttttgagtgtctatgctgatatgtcagagacatgcaaggtaatttctcctcaattttgttcttcatcatgtaatacatgctgtctcattcgcaaacgtctactatgtgctattcaatcgaaggcatatgtaatgttatttaatcaaaagcatatactgtatataagtgctttgtcacttccaaaactatgtctgttttttaatcccctatcgatttttttatttgttatttatttcttaattgttttgttagcttgttatatgtttgtctttgagactttttggttgttatcattgaacatctttatgacttactcctttcggaatcaagttacacatacaatgaaagtgtgtatgattaaatttgtcaataggctattatttgtttgagtgatgaggagatgataactttattcctactataaagaaaaggtctactttaaaacctcgtcttgtcattaattatgagggttggatgttgggattgagataaatcaactgataccagaacccagaaggggaaaatgcagaaatactacctcatgagctgtggctgacctttctgttcccatgatcttgtcttattctatgagtatgaactaaagtagtagagtgttcccaatcttttggagcgtacaggaatattatgatccaaaccggtccatgctggaattggtttttgcacctgcagaagaatgggtttctcggagtgacacggacattattgaggcaacaatgaacgaacttgccaagctttttcctgatgaaatcgcagctgatgggagcaaggctaagatcctaaaatatcatgtagtcaaaactcccaggtgagataatatgtactatactgctctgtattagttagatttggtaatcgtttgtggtattaagcagaccttatctgctgaaaagcagtatcgatatttactactgttaaggtctctaactgttaattcttccattccttcacaggtctgtttataagacagttccaaactgtgaaccttgtcgaccattgcaaaggtcaccaatagaaggtttctatttatccggtgattacacaaagcaaaaatatttggcttcaatggaaggtgctgtcctgtctgggaagttttgtgcacaggctattgtacaggtaatgaggttttgctcaaacatcataagcatgatattcatgagtttcacttcctatatctcctagaatcctcatgatattgttactctataaattatgtttactgaaaatttagtcctattattcatttgcaggattatgatatgcttgttgctcgagcacaaagagaattggcaggggcaggcaacgcctgatttgaaattctttgatatttgcccatttttttcgtcggagatttggattggtgatcttgttcagatcgagttcagatcgatattcaactactggaaacaaactctgggaagcattctcagttatactcaatttttttttctgctgttcaagatgtatatgtgtagcttaattgtagggaaacatgtacaggcatgtactcataagtggtttcaaatgtaagtagtaattcaatacatgtactaacatttctgtggaaataggaaactgttttagaagagtgtcccctttctacttcgtaaatgacatttagattgtggctttgttgctgggagcatggtccggcttggttaggaagcacgaggccattgcccgaatgccgccaatgtggattgatggatcttctcttagcttcttaaggggttagtctttttccatgatacttcctcagttattgaaagaatgtaaaccttttttttttttttcattttgtcgtgaaacttcgcaattttcaatcttatacgtgtatgaaacttcgatattacttctccatatttttaatcacaacacgtatggattgccggattggcaataaagttgatgatagagaaaatatgtgggggcatatgaaattcttgtgagagtaaagtggtggtcttgtataccattttaaaaacgtcgtaaacattttgaatcaactcaaaaatataaaaagtgtcccctttatacttcattcatttgcatttggacatccctttcaaatattgctaagcttagcttagcgattagggttgaaccttttaaccttgaggatgcaggttaaatttttactaaagcatttcggggtttttctattattactctttcccccctacttttaaagcgtctagtcatcaaacttacagcggatcgatgtttgaatacgataacgttatcctacaaaaaagaagaaagggtacctcaaccccaattccccaagacctactcccaaagtccaaaacaacatgagtggatttgcaagttgcaaataggcattaggcatatattatttgggcaaaatagtagtaattggagttgcgttgtgcattctttgaagattaactacttgagtgtgcgtgcagtcggtgccgtcagtaacaaactacatacacatcacatctcgagggatgaaccccccattaagctactctacaagaaccatgaacctccatggggacacccacactatgctactaagcaaaatccttaacatcctcgactagatatatacttcttccgtttctttttactgtaaatgcaacaaaagtatctttttgttttcacaaatgtcgatttggcttgtaaagcttgtgaattggctcgatttttatttttctttcgcaatttcataaaactcgttacacttttcattctaagatggtctcacattacttgttatacttttttttttttgtaataaactatttattatatatctcttctcacatgagtcctccttgcttttttattctctatctcctccctctccaaaaatcagtgaattgagaaatgtagcgagtaatatgaaacggaagaagtactttggaaaacatttgtactatcaatacatacatgaaaacaatgatcctatctattacatatatgacaagattaagaaattcactgtctattaaaaccaacaaattgaatattaattgaagaagaaaagaaaaacataaaaactgaaggtaataatgtactgtataaaacttgttcatgaatagtttgaaaaaag

SEQ ID NO: 68 - DNA, 10701 bp, Kochia scoparia
aatgcttaaacaattaaaattaacataatttgtaggtgaggcatgctaggtttgatcaaatttagacatgagtgacgaattgagtcttgcctaataggatcaaactcatgatatgacatgcactatggattattttgcatgagatttttataaaacttgatataatctacctaactaatgtatgtcctgattgacatttgagttgtccaacaacgtgccacgacatcaattcaagagttcttcgaagaaaataagtaaataaccccaatctcaaggataaggagatttgaagggtaaaaaaacttgatctacccattgagtagactacccaccattaattgacagggtagaaagtggaaaattcctagtcaatccaatggattgataatccaatggcattttggtaaataaatggaaaaaaagaaaaaaataaatggcaatgttgtaaataaaatatttcatttatttactaaaataccattgaattgacaatttttgtcaatccattggatggactaggcatccctcgtagaaagtggtgacaatagaatttcactcaagttataaacaatagatatgtgtatgcgatccattaggtaaatgtaatcatgtccgagccgaagggatcaagcctagacactagtcaagcttgggttggtaaaatggtaaacacttcgtatgtattgaagtattgtaagtacatgaataaccgtaaaggctctaaagctactactactactaattgggtaaccgcaatatgtgtggacagttcgaaagccacacaatttgagtggcattttccatttttcaattctctctctctctcagtggctcaaacagaaatcgcattacacccacattccacaaatggccctttgataaagcactaaacctactctactcctacactccttcatctaatctcaatttccgttacttctttggttctattgcacacccttttacacccattgcagtttatattccactgaatttcgtattgcaaacccaatttacaaaaattgcagaagaaaatgagtcattttggatatgcttgtgctacccaatccacttcaagatgtgttcttttgggcaattctggtaaccccacttcagtttcatctcgtggcagtgatttcatgggtcattctgtaagaaatttcagttttagcaaaagacagagaattgggcactgcccattgaaggttctattgcttgctttcttgtttatggatcaattttgtgggatttgatgaaaagattagattttgtttatagttgaattaatcgagaattttaatgtatgatgcaggttgtttgtgtagattatccaagaccagagcttgaaggtacagtcaattacttggaagctgcttatttatcttcaacttttcggaattcacctcgtcctcaaaagccgttagaggttgtaattgccggtgcaggtaagtgggatgtttcctgtaacttgctttgttcattagtttcttgttcttttgcttgttgctttataaactagtgatgtttggtatgtgtttggtgtaatcattgtcttactgatatggaaaggattatgtaggagggaaaagggtagtgataattactgggtgtttggctaaggatgttcagcatagcatggttgtctcttacaaccacactcatgtattaccatggtaagggttgtacttagaaaattgttgtatttggcaattggcaatacaatggaattgaaccatatttcatgaaggaccccctttggagagggtaaggtggttttaattgtatccataggttttcaaagggtgacaagtggagggaaatggttaccttcaggaaatgaggtttgttcctacacttacaccaaatggtgtgcaattacaccttaaaatccattaccaaacacccttaggtttcggtttatcatctgttagaggcctaccaatgagaatttcccttacgttaatgaagtaatgggttttgacaccttttttttttatgttgcatgttcgaaataagctttgtagtttgaagtagcttacggctaatagctgttatgcgggaatattgtgaattggaaaaagaataagagagtacttgcttcaaggatcataaggtttatgattgttggaatcatctttagtgaaattttgattttcaactgatctctacggtaactattggtccttcaaaattctagacgcagaatcgtttaggtgagggtgaactctgattatgaatagtcaatgtctctcccaacgtgaaacttattagttctagctgttatgtgctccaattcgaggaacatcgtgaattggagaaagaatactgcttcaaggatcatgagtttatgattgtcgtaaacttctcttagttctttagtgaaatttcagcagattttaatggtaattagcagtccttcaaaatcctagatgcggaatcatctagggcatgtatatggtaaactctcatgatagataactagtgtctcctccatgtaaactttattaggtattttctttgtcaaaaagagtatttttcattggaaaaacaatataatggtgactactgcatatgtttggttagctattcctgttgcaaatcagattttgaatggaacatgtcttattcccttctagagctctcctggtgcaattctagcattttcccctcaataagtggtatttgagctaatatttcaagtctagacattatagcatgctataatgaggcggaattgtttgagccatgttaaagggttccatgacatgtaatatgctagtttatggcagggaacagggagttgggtccttgccttcatgggaaaagagagattgttaggtatttcttaagtttgcatgggaaagagttcttttatctttatagtgaaagttgactagtatgcaagtatggtggtggattacccttattgccatttggacttgtatgctatttagtgcatatacttcagcctagcttaatcttgacaaaaatgccttgagttctagtggtttgctttattcattggttgatttgctatttctgctagtgaaattagagagaaaattgatgcctgtttcagtgtttctcatcaaggtaaatggacaaaactgtctatgtcttgaaattttctgtgaatactcaagcaggcttccttggtttgcttcaggctgattttcattgcctcagtttctgcttgttggtatcagaataaaaatagatacttttatgtatttgtgagagatttgttggtagaaccacatttattctgagaaatatttgtacaaatgggagtttaaggttataagtgtgtaagccttttgaggtattttgttttaaaaatcttatcgttatttcagagcagcaagttacatatagtaaacttgggagcattggagatgtgatggaattagattcaatatattttatcatcaagatatgagttctaattcaaaactttccttctaggtttggctggtctatccacagcgaagtacttggcagatgcaggacacaaacccatattgcttgaggcacgagatgttttgggtggaaaggtatgtgcttatatgctattttttcagaaatatatcctttgtgcttcttctcttctcagtttatgttgactataataaatgaaacagcttaattgtcttggttgtatgctttcatagtattatctaggctacatggttatacggacatatattattgagtggagtgatttagtcatcttaagtggttatttacttttattttatagctgttgaagttattcatcattctgtacaatgttaagtcagtgttaatgaggtttagagggtaatggactaatagacaagctttgtgctgtgaacggtttgagaacatgtgctattgggactgatgttatgcaatgtttgtggtagtcttccttcttatgcatttgtttattgttactgtttcacaggttgcagcgtggaaagatgaggatggtgactggtatgaaactgggctccatatattctgtgagtataatattttgcttttcagcttagatatcctgtttaagcttctagtcctacaatttatgttttctgctgagtggatttttgtaaaagttttacgggatctgtgcaatttctgccttctgattctgttattatttggaagggcgtgatattgtgacaatttcaaagtggtttcactccagacaaaagtcaaactaacaattcaatgtactgaatacccttttattttcttgaagttggggcttatccaaatgtgcagaacttgtttggagaacttggtatcaatgaccgattgcaatggaaggaacattctatgatttttgcaaggcctgacaaaccgggtgaatttagccgctttgattttcctgaagccctgcctgcacctttaaatggtgagtatttgacaccttatattctttagcaaactaagtattgtataagccaaactgcacctggtgacattcattgatttctttcttgctcaccgactttccttgagattctagcaacatcttattctccgtcttctaatgagtaaactagttttgattctgttcattcttaatgtgtttggcaggcatatgggcaatcttaaggaataatgaaatgctaacatggccagagaaaatcaagtttgctattggtctcttacctgctatggctggtggacagtcctatgtcgaggcacaagatggtttaagtgttcaagagtggatgaaaaaacaagtaggaacaaacgatcatttttaaaaccttatttttcaaattccttgatgattgtctagattgttagttcattacatgtctaactttaaacattgatgttacagggacatctattttatttatttttgaaaattccttttgcaaattttgtagggtgtgcctgatcgtgttacagatgaagtattcattgccatgtcaaaggcacttaacttcataaatccggatgaactttcgatgcagtgtatcttgattgctctgaatcgatttcttcaggtatagccccatttcactatctgctttaagtgtgttttattttcaattgaattcgacctattcaactatatggaacttaagtaattttgatttgaacttattgatacaaacgtatcaaaacttacgataatctttttcagtttgatacactatcgttttgtttctgagaactttttgtaaattggattatatgtgatgttaaaattatggaattcactcaacaggaaaagcatggttcaaaaatggctttcttggatggaaatcctccagaaaggttatgcatgcctattgttgagcatattgagtcactaggtggtgaagtgcagcttaactctcgtattcaaaagataaagttaactcaagatggaagtgtggatagcttcttgctaaccaatgggaaagaagttagaggggatgcttacgtctttgctactccaggtttacttttcttctttaccgaatgggattattattcaactaggaaattattgccatttttagtcaagacaggctcctgaagaaattatttattgccatctgtattgttctctgatatacctttaaatttttattacagttgacatcctaaagctacttcttcctgaagagtggaaagaaatttcatacttcaaaaagttggagaaactagtaggagttcctgtcattaatgttcacatatggttagtgatacctcttgtctacaggaatatagtttcttaatgctataacccaatcttatgtgtcttctcttactctatgtaattttatttatgtatctatctttctcttccatgtccatgtattttgttatttctgtctttggctttttagaatggtttgtcagtatatctttgcaattaggctctgatttaatagcctgctactatacgaagtatatcatttctttggtagtgtattttctgtagtttgcgttgagagtttgagactcctatacgtagagcttcatcttaataaaattttatgtcttgtaaaatctgtctgttttgaaatgtcaaaaaagctgtcaaaatctatttctcaccctctccttatgaagaacttcaatgaaatctcctctaatatcgggactgacatttaacaactgttggcttgcaggtttgataggaaattgaagaatacatatgaccacctactcttcagcaggtgtgttcaattaaagtgctaaattcaatatcattttcatagcactcaaacaatactcaaagattatccttccctttttgtccttgttttatactcatttcgttttccctttttttgttggaaagcacattttgttgagcatatgccatgagctgcatacttgcataaaattgggcaaaggagccacagtcatttgatatatatgatttaagaatcctcctatgaagttagaaaagttatggtactagttttcttttactgagtgaacggggtatccctgccagcaatgtgtacaaggatactggcttgctgcagaaagatactttcagtattgataagatacaaattgcatttttcttttggatgaaatacagtgaactggcaatggtgtcagcttgaacgttgagaatccttgatatccatttgattcatgttttcacttgtgcgcggatttcactcctataagtttgtcattgcaggagtcctcttttgagtgtctatgctgatatgtcagagacatgcaaggtaatttctcctcaattttgttcttcatcatgtaatacatgctgtctcattcgcaaacgtctactatgtgctattcaatcgaaggcatatgtaatgttatttaatcaaaagcatatactgtatataagtgctttgtcacttccaaaactatgtctgttttttaatcccctatcgatttttttatttgttatttatttcttaattgttttgttagcttgttatatgtttgtctttgagactttttggttgttatcattgaacatctttatgacttactcctttcggaatcaagttacacatacaatgaaagtgtgtatgattaaatttgtcaataggctattatttgtttgagtgatgaggagatgataactttattcctactataaagaaaaggtctactttaaaacctcgtcttgtcattaattatgagggttggatgttgggattgagataaatcaactgataccagaacccagaaggggaaaatgcagaaatactacctcatgagctgtggctgacctttctgttcccatgatcttgtcttattctatgagtatgaactaaagtagtagagtgttcccaatcttttggagcgtacaggaatattatgatccaaaccggtccatgctggaattggtttttgcacctgcagaagaatgggtttctcggagtgacacggacattattgaggcaacaatgaacgaacttgccaagctttttcctgatgaaatcgcagctgatgggagcaaggctaagatcctaaaatatcatgtagtcaaaactcccaggtgagataatatgtactatactgctctgtattagttagatttggtaatcgtttgtggtattaagcagaccttatctgctgaaaagcagtatcgatatttactactgttaaggtctctaactgttaattcttccattccttcacaggtctgtttataagacagttccaaactgtgaaccttgtcgaccattgcaaaggtcaccaatagaaggtttctatttatccggtgattacacaaagcaaaaatatttggcttcaatggaaggtgctgtcctgtctgggaagttttgtgcacaggctattgtacaggtaatgaggttttgctcaaacatcataagcatgatattcatgagtttcacttcctatatctcctagcatactcatgatattgttactctataaattatgtttactgaaaatttaatcctattattcatttgcaggattatgatatgcttgttgctcgagcacaaagagaattggcaggggcaggcaacgcctgatttgaaattctttgatatttgcccatttttttcgtcggagatttggattggtgatcttgttcagatcgagttcagatcgatattcaactactggaaacaaactctgggaagcattctcagttatactcaattttttttctgctgttcaagatgtatatgtgtagcttaattgtagggaaacatgtacaggcatgtactcgtaagtggtttcaaatgtaagtagtaattcaatacatgtactaacatttctgtggaaataggaaactgttttagaagagtgtcccctttatacttcgtaaatgacatttagattgtggctttgttgctgggagcatggtccggcttggttaggaagcacgaggccattgcccgaatgccgccaatgtggattgatggatcttctcttagcttcttaaggggttagtctttttccatgatacttcctcagttattgaaagaatgtaaaccttttttttttttttcattttgtcgtgaaacttcgcaattttcaatcttatacgtgtatgaaacttcgatattacttctccatatttttaatcacaacacgtatggattgccggattggcaataaagttgatgatagagaaaatatgtgggggcatatgaaattcttgtgagagtaaagtggtggtcttgtataccattttaaaaacgtcgtaaacattttgaatcaactcaaaaatataaaaagtgtcccctttatacttcattcatttgcatttggacatccctttcaaatattgctaagcttagcttagcgattagggttgaaccttttaaccttgaggatgcaggttaaatttttactaaagcatttcggggtttttctattattactctttcccccctacttttaaagcgtctagtcatcaaacttacagcggatcgatgtttgaatacgataacgttatcctacaaaaaagaagaaagggtacctcaaccccaattccccaagacctactcccaaagtccaaaacaacatgagtggatttgcaagttgcaaataggcattaggcatatattatttgggcaaaatagtagtaattggagttgcgttgtgcattctttgaagattaactacttgagtgtgcgtgcagtcggtgccgtcagtaacaaactacatacacatcacatctcgagggatgaaccccccattaagctactctacaagaaccatgaacctccatggggacacccacactatgctactaagcaaaatccttaacatcctcgactagatatatacttcttccgtttctttttactgtaaatgcaacaaaagtatctttctgttttcacaaatgtcgatttggcttgtaaagcttgtgaattggctcgatttttatttttcttttgcagtttcataaaattcgttacacttttcattctaagatgatctcacattacttgctatacttttttttgtactaaactatttattatatatctcttctcacatgagtcctccttgcttttttattctctatctcttccctctccaaaaatcagtgaattgagaaatgtagcgagtaatatgaaatggaagaagtactttggaaaacatttgtactatcaatacatacatgaaaacaatgatcctatctattatatatatgacaagattaagaaatttactgtctattaaaaccaacaaattgaatattaattgaagaagaaaaggaaaacataaaaactgaaggtaacaatgtactgtataaaacttgttcatgaatagtttgaaaaaaggttcgaacaacaattggtcaaaacttaaattaacaaactcaaagtcgagattaagctcgagtaaacttaaacaaacactaaccgagcttatttttttagtttttttaataaaatcacaaaacattagaaaaaaaaatctagaatacaccaagtgtaacaaagaaatgttgtccttttactcgaataagattcacaagccttatacaaatccttaattagcattacattatttacatgatacattgcattggggcacaattatataaccaaggatcatgataacccaccattattttttcaattagataagttgataccattgcttaaaatcttaacaaaaaatctatatatcaaccttaataaaatttaaaatataaggtttacaatattatttaataaaattgatatcaacattcttagctttttggtgcatgttgtaacttagaaaatggtttgattttattttcatgcaccacaaatgaggctaatcatctcacttcaactcacacatacaagagctgttatgaactcctattctgaagcccaatttactgaaccttgagattgagattaaatttgtccttttatttgaaccttaaagtgtaattaaagtttaaagtttttgttctaataataatattccttaaacagatattttttttttatatgattgttctctttaagatgcatgtttagaagcaataattctcacatatttaagaaagtgctaatttgaggtaattgtgttggatgattgggtgcgaatgagccgcaatgctgaataacggacttttattaatattaaccattaaaccaagacttcataataaccccctatgaaatgtcccttatacccttaatgaattaaattacaatatttaaaaaaaattaataatatatttttactcttcaattgtcaatttgccataaatgttgaataagtttaata

SEQ ID NO: 69 - DNA, 1685 bp, Lolium multiflorum
gcgcttatcgttgattaaaccagggctgacaagaatctaccagcagctgcttcattatggatacaggctgcttatcatctatgaacataactggagctgcgcaagtgcggtcctttgtgggacaacttcatacacagaggtgcttcacaagcagcagtgtccagccgctgaaaagtagttctccaacgagcgctggtttggcgtctcttggctcaaggaatagagggaaaaaatcacgccgtgggcttgctgctctgcaggttgtttcccaggatttaccaagacctccactggaaaacacaattaactatctggaagctgggcagctttcttcatcttttagaagcagtgaacgacccagtaaaccattacaggtcgtgattgctggtgcaggattggctggactatcaactgcaaaatatctagcagatgctggccataaacccatattgctagaggcaagagatgttttgggtggaaagttagctgcttggaaggatgaagatggtgattggtatgagactggtcttcatattttctttggagcttatcccaacgtacagaatttgtttggtgagcttggtattaatgatcgcttgcaatggaaggaacactctatgatatttgccatgccaaacaagccaggagaatacagccgttttgatttcccagaggttttgccagcgcctttaaacggaatatgggccatactgaagaacaatgaaatgcttacttggccggagaaggtgaagtttgctattggacttcttccagcaatgcttggtggccaagcttatgttgaagctcaagatggcttaactgtttcagagtggatggaaaagcagggtgttcctgatcgagtcaacgatgaggtttttattgcaatgtccaaggcactcaatttcataaaccctgatgagttatccatgcagtgcattcttattgctctaaaccgatttctccaggagaagcatggctcaaaaatggcattcttggatggtaatccacctgaaaggctatgtatgcctattgtcaaccacattcagtctttgggtggtgaggtccgcctgaactctcgtattaagaaaattgaactgaaccctgacgggactgtgaagcactttgcattgagtgatgggactcaaataactggagatgcttatgtttgtgctgcaccagttgatatcttcaagcttcttgtaccggaacagtggagagagatctcttatttcaagaggctggataagttggtgggagttcctgtcatcaatgttcatatatggtttgacagaaaactgaaaaacacatacgaccaccttcttttcagcaggagtccacttttaagcgtctatgcagacatgtcagtagcgtgcaaggagtattatgatccagaccgttcaatgctggagttggtgtttgctccagcagaggaatggattggacgtagcgacgctgaaatcatcgaagcaaccatgcaagagctagccaagttatttcctgatgaaattgctgctgatcagagtaaagcaaaaattcgtaaataccatgttgtgaagacaccgagatctgtttacaagaccatcccagattgtgaaccttgccgacctctgcaacgatcaccgatcgaagggttctatctggctggcgattacacgaagcagaaatatttggcttccatggagggt

SEQ ID NO: 70 - DNA, 1670 bp, Lolium multiflorum
  unsure (1)..(1670): unsure at all n locations
aaggaaacagtgcaccagcgtcgtcgtcgcccgaccaaaggtcttagattttcaccctgaagatagtccccactctcaaaacaatgcctccaacaagaacattgccaggcacaaccagttaaggccnnnccttgggttttcaccctgagaggtaagactctgagcttcccctgtgctgccgcccccnnatgcataccactgctgcagagcctggaacgccgagcagatccctcagcatcacggagactcaaacctcctttagccagtccaccaatctggccttcatgatattccttcttctgacttcaccatggaccaaaaagtcacctgatgtacacacagaatagagcttcgcgccgctccttccggaaccaaacggtcggaataaaaacatgggtgcgcgcgaccgaataccacctgatccagcaaactgcaggcaaaagatgcactgttccattcaccagcggagctttccggaactcatctctccagctagatcaaagcaaactgatctccggaagatcttcatcctcgcatgcgagaaacccgaggaccgccaccaaaaacaaagaaagatcagcagcccccacgccgccaatccctcttgccggatcaccaaagaagaggacagcgacgcagatcatgcgtacggccgccaaaccgttaccgggggcggaggccgccaccgctccaccgaatcctccatggctaccgacggagagcctcaggccccagccaagtagccgtgccgcccggcttcctccactggcgctacatcacctcccatggaacgccgccgcggaaaccctcttctccccctcgtcgattcgacgaaaggggtgccgccaccaccgctagagccaggccgggaccggggccgaggcacgggggccggggccgaggccagcgccggggtcggggccgcggccggaagcggcagcggctgagggcgacgggcggcgggtggatgtaggccgcggggggaggaggagcctccgccgccgcccgggaggggggcgggagaggggggcggcgggttagggttaggtgagtagccccagatgagtcaaacttctattgttgtgttggtgcgttatggtatggcattattgtggtctaatcacctctctgcttgcaggattctaaattgttgtcccgtaggagccaggaaagcctgaagacaaaatccgaagttcccgtcgcttcctaggtgtatttaattagcacacaaatcattcttagcacattctgtggtattttcacactgttgtagagttgaacaggtgattgagctgatatccatattgtgaaaaaggaaatctgtaaaacgagaagctgcataaaagcagctctgatccatatagcaattcttacgttagacctttccggaaggcaaaagtgataaaaaaaggatcttagatattatcttcgtttgcaacaattggaactggatcattaaccgcttacttttctggaattgtataacattaaaacctaaggttcgtgtcagcaaaaggggatgaaatcatggataatatcctagcatctaaatcttgtaagcaaatgggatttatgatatttggcagttgcaacaccaagctgcagttacaaaaaggaggcacagagacaggccctgagatagatgatggggcctcagtaagtgagatatt

SEQ ID NO: 71 - DNA, 1612 bp, Lolium multiflorum
caaaagttcagaacaaaaaaatagagagaaacaccaaagttgtttctctgaaaccgtcatgccattctttaaaaggaagaagaggtattttcaaaacatcgtgcttcactgcttctgctgattatgtgcatatacaaagttataagttcattggaaacgatactagttagcctttagacatgcatttggatccctgctttgtttcatgttgttagcaaattcctacacccttgaaataaaaagattattatcttgctgttcttttaaagggtaacttgattgtgaacgtgatgccggcgggctggacagatgggaggcacagactttatataagctccatggaagcctctttcatcgatcaactctacggctacaaagtaaatcagaaagcccatgacttgaaaatcatccgcggtggagtgttggggaaactcaaatcgcagaggaccaatgttcgtgctccagtaacgggtgaatgcctcctgcctgcaaacccgtggatgcgtgactgcagcagcagcagcagcaatgcaagaagtgatgtagcaaaaaccgcagtgggtgatcacgagtctggtatatggactatccatgggaggagtccgctgtcgcatgaaagggaattgggagcttgcaatggagaaaaacttctccatgataatacaggtagctatctcagttacctcattcaacttccggtgtatcatatgttttcaacactagctgattttatggaagatgcatgaacaattcaaaaatcaattgtgtgtaagctccaagatgctgtctgtctgaacgtacctatgttagcaataagctcgtaaaagttagactgctaaccatgctctgaagcagtctgctacgaagaactaaatatctgatgccattttttttctctccctgcagaggtctctgatgagaacttttctgactacgagacgaaactcgatgcggaatcaagtaaattgtgcaagaaaaggaggttaagcagtacttccacttactgaatgatcaaatgagctcgcatgattaattagcatatagtgtgttgcaagcattgagatgaaaagcaacacaccgaattactcaaagaacctgtttgctgcctcaaaatctgttcggagcctgtttgtatcctgtcagacgccctcactcactacttggagtagtagataatattgtttcgtttattggatgcaaatgcaatgcattctataaagtttgactaattatatggaaaaaaattaacaactaaaatatcatatcactgttattagaaccaccatggaatatattttcatagtatatgcatttggtattgcgatgtatgctgaaatagagtgggtattatctctaggaggcttcttcctttcaagtcaagttttgtatcccgatatatactcacccgagaccgagagacaccgatacaacaatgtccaaagagtaacgtcaatttcatactctttcaggaaccatgcatctaaggcaaacgttgtaattaatcaataaggtacaatatgagaccagagtgtggtgcttggccggggccaaatattttagtaatgtaatcccaagagagtagtatgtcgtgtaatgcctaggatttgtctga

SEQ ID NO: 72 - DNA, 1352 bp, Lolium multiflorum
aactgaaccctgacgggaccgtgaagcactttgcattgagtgatgggactcaaataactggagatgcttatgtttgtgctgcaccaggtgtgatttattttcaagaatcatgttttctttacacctgttcagtttaactgactagcctgttattcagttgatatcttcaagcttcttgtaccggagcagtggagagagatctcttatttcaagaggctggataagttggtgggagttcctgtcatcaatgttcatatatggtgagttgattgaaactattggttctaagtcaagacaacttcgtgtttttcggttcgacttatatggtcctgcctcatgtgttatttcaggtttgacagaaaactgaaaaacacatacgaccaccttcttttcagcaggtattcctttcttcatactcatcttcctgttggcacctagtgcattttgttgtcttgtattcaaattgagcgtcttcaatcctacccctacatgctttgaatgtgtttttgtttgataccaagtaccagatgtcccttatgttgatcttgttcacttctgtttcaggagtccacttttaagcgtctatgcagacatgtcagtagcttgcaaggtactaactcaaggagttattaatattgcatagatactaatatgaggcatgtgatcctgcattcttcttggaatccaccatattaagtattgattgcgggttaaccggaattgtactttgaggactattgaccaaaggcccaaaatgcttttgctaagaaggaatcattattgaacttaaaattatagatacctttggcattgcaaattgtagttataaattactgaagtatagcatttttgtcattgctaacatgtccgttggctgttgatttcgtgaatcattttagttagaataactgaataaccgtgctagcttaactgaaagaacgaaggacatggatgcatactcgtaattttattttttccttgttctttaactctatgcaggagtactatgatccagaccgttcaatgctggagttggtctttgctccagcagaggaatggattggacgtagcgacgctgaaatcatcgaagcaaccatgcaagagctagccaagttatttcctgatgaaattgctgctgatcagagtaaagcaaaaattcgtaaataccatgttgtcaagacgccgaggtgaggacattttgctaacacccatcctgttgattaatcaaaaggacacctgatgtggtcttgttctcttacactgtttatatttttctggctcgctgttacagatctgtttacaagaccatcccagattgtgagccttgccgacctctgcaacgatcaccgatc

SEQ ID NO: 73 - DNA, 1210 bp, Lolium multiflorum
cctttgtactctgtgtataggttatatccattggcagtgtacagatagtatttgatgcctcagacaaatatgtacacaataataagatagaacaccttgagtgaagtacaaagtgatttttgagtagtcacattgaggttctgaaattgcaaataagagaagagtttcatactgtcaaatttttagcttgtttgcattttattaatgggccttattctcttaataatatttttaccgggttttttgcgtgactgtatgaaaatatataagggattcacgcatacagtagcttagattttaatgttccatacatcattgttggcctggttgaatttttttttgtctataaattctcttctaccagccttttctccctgccggtagcttgtgtacggtacttctcattctgtgcatgtatgtaaccatatgttttttttttgggttttaagttggagcttatcccaacgtacagaatttgtttggtgagcttggtattaatgatcgcttgcaatggaaggaacactctatgatatttgccatgccaaacaagccaggagaatacagccgttttgatttcccagaggttttgccagcgcctttaaacggtaagatcatacatagccctggtgttgcttaatagatgaaagaatggcaagaaaacttaggaatgcatcctagtgttagttctttcattttgctaatatttgaatgcaactagtggggtatgttagtgcaaacaacattgtcatggccatccagctgttctcttcccatcaatgtcagtttatcattgattatgcatgtatttaacaggaatatgggccatactgaagaacaatgaaatgcttacttggccggagaaggtgaagtttgctattggacttcttccagcaatgcttggtggccaagcttatgttgaagctcaagatggcttaactgtttcagagtggatggaaaagcaggtatgagcccaccaagtcagttagactcatctctttgtactgaacacatagccgtctcaattcacacttgatatatgaggatatgttgtaacgcgataaattgctgccttccttctattgttatatttttatgaagaagtgtggctaggtccataaatgaaactatatgctcaagtttccatacttttttccacccagcccttttgtatgcaatgtaggcttaagtaatacttatatttctattaatc

SEQ ID NO: 74 - DNA, 1057 bp, Lolium multiflorum
tcttggctcaaggaatagagggaaaaaatcacgccgtgggcttgctgctctgcaggttaagatttcgtccctgttcggaaaataaagtggtttctctattttatctcaccacagccgtttcttgtgaagtaattgtttgcattttctgcaggttgtttcccaggatttaccaagacctccactggaaaacacaattaactatctggaagctgggcagctttcttcatcttttagaagcagtgaacgacccagtaaaccattacaggtcgtgattgctggtgcaggtctgatgtaactcctggattagaacatatatgaatttcacaaattagataccccccctgagtgaagcacaactgcctcttagcgttactcgtctctggtgtgaattgtgcaggattggctggactatcaaccgcaaaatatctagcagatgctggccataaacccatattgctagaagcaagagatgttttgggcggaaaggtctgatagtttcttacatctgttgcttatctcatctctaaaattgtgctggttatttaatctgacttttcagttgctgtcgtcattctgagtagctcaccttcaccattattgttgcttgattgcttctatccttgtatgccttcaacagttagctgcttggaaggatgaagatggtgattggtatgaaactggtcttcatattttctgtaagttacggtacttccttgttcctttgtgccctgtgtatagcttgtttccactggcagtgtatagatagtatttgatgcgtcagacaaatatctacataataataagatagaataccttgagtaaagtacaaaatgatctttgaggagccacattgaggttctgaaattgcaaataagtgaagagtttcataccgtcaaatttttaggttgcttgcattttattaatgggccttattctcttaataatatttttagtgggttttttttttgtgtgaccgtatgaaaacatatagcttaaatttcaatgctgtgcatgtatgtaaccatatttttttttgggttttaagttggagcttatc

SEQ ID NO: 75 - DNA, 999 bp, Lolium multiflorum
attacagatacctttggcattgcaaattgtagttatcaattactgaagtatagcatttttgtcattgctaacatgtcagtcggctgttgatttcgtgaatcattttagtttgaataactgaataaccgtgctagcttaactgagagaacgaaggacatggatgcatactcgtaattttgattttcccttgttctttaactctatgcaggagtattatgatccagaccgttcaatgctggagttggtgtttgctccagcagaggaatggattggacgtagcgacgctgaaatcatcgaagcaaccatgcaagagctagccaagttatttcctgatgaaattgctgctgatcagagtaaagcaaaaattcgtaaataccatgttgtgaagacgccgaggtgaggacattttgccaacacccatcctgttgattaatcaaaaggacacctgatgtggtcttgttctcttacactgtttatatttttctggctcgctgttacagatctgtttacaagaccatcccagattgtgagccttgccgacctctgcaacgatcaccgatcgaagggttctatctggctggtgattacacgaagcagaaatatttggcttccatggagggtgcagttttatccgggaagctctgtgcccagtccatagttcaggtaaatgctttccacggttctggttgcacatagatgagtcaaacttctattgttgtgttggtgcgttatgatatggcattattgtggtctaatcacctctctacttgcaggattctaaattgttgtcccgtaggagccaggaaagcctgaagacaaaatccgaagttcccgtcgcttcctaggtgtatttagttagcacacaattcattcttagcacattctgtggtattttcacactgttgtagagttgaacaggtgattgagctgatatccatattgtgaaaaaggaaatctgtaaaacgagaagctgcataaaagcagctctgatccatatag

SEQ ID NO: 76 - DNA, 677 bp, Lolium multiflorum
ttcaacagttagctgcttggaaggatgaagatggtgattggtatgaaactggtcttcatattttctgtaagttacggtacttccttgttcctttgtgccctgtgtatagcgtgtttccactggcagtgtatagatagtatttgatgcgtcagacaaatatctacataataataagatagaacaccttgagtaaagtacaaaatgatctttgaggagccacatttaggttctgaaattgcaaattagtgaagagtttcataccgtcaattttttaggttgcttgcattttattaatgggccttattctcttaataatatttttagtgggtttttttttgcgtgaccgtatgaaaacatatagcttaaatttcaatgttccatacatcgttgttggcatggtggaatatttcttttgtctataaattctcttctaccagcatttcctccctgccagtagcttgtgtacggtattcattctgtgcatgtatgtaaccatatgttttttttttgggggggtttaagttggagcttatcccaacgtacagaatttgtttggtgagcttggtattaatgatcgcttgcaatggaaggaacactctatgatatttgccatgccaaacaagccaggagaatacagccgttttgatttcccagaggttttgccagcgcctttaaac

SEQ ID NO: 77 - DNA, 653 bp, Lolium multiflorum
agtacctctccgagctccacatattagccttgggtgtttctgcctcctttggtcgatccttctctgtgtctgatgatcaccggggagatgagcgaaacgtctgtggatggaccgcttaaggcacagccaccggccatccgcattcctcaggtaacaacaactcctcttgcaggcacgtggtccttgtttattttcatttttgttcttgctgctcattactttcatgctttgcttcctaatgatatgcttgctccatttactaacagttacacattcggcagattcatggtcaatctcttgttgcggacataaaactccttttattttttccaagtccgaaattatttgcatacatagatgttgctatcatattcttgttcccttgaggccttgacgacataataaaccgattactatcttgttctttggcagggcacgttaacccttttcttttcaagtccaaaacaaataaatcttgttcgtaacagaaaaaacaaaggagcacccaagtgtgctgtttctctgaaatatataccctcatgccattgctcaaaaagaggtatcttcagaatatgctgctcctgctccttatgtgcatataaataactataggcttatgcttccatacacccccaaatctcaaaaccgattgc

SEQ ID NO: 78 - DNA, 189 bp, Lolium multiflorum
atcgaagggttctatctggctggtgattacacgaagcagaaatatttggcttccatggagggtgcagttttatccgggaagctctgtgcccagtccatagtccaggtaaatgctctccacggttctggttgcacatagatgagtcaaacttctttttttagataaagggaatatattaatatcaaaaga

SEQ ID NO: 79 - DNA, 200 bp, Abutilon theophrasti
ttgaagaaaatgagtctctgtgggagtgtttctgctgtgcacttaaacttccaaagcaacacgataagcatgggaagtgttttagcttttagaagcggtgaatccatgggaaattccttgagaattcccttaaaaaagaggtcaagtaagggtgcacgtcctttgcaggtagtttgcatagattatccaaggccagagct

SEQ ID NO: 80 - DNA, 200 bp, Abutilon theophrasti
agctctggccttggataatctatgcaaactacctgcaaaggacgtgcacccttacttgacctcttttttaagggaattctcaaggaatttcccatggattcaccgcttctaaaagctaaaacacttcccatgcttatcgtgttgctttggaagtttaagtgcacagcagaaacactcccacagagactcattttcttcaa

SEQ ID NO: 81 - DNA, 200 bp, Abutilon theophrasti
gcatagattatccaaggccagagcttgagagtactgctaactttttggaggctgcttctctatctgcttcttttcgttctgctccccgtccaactaagccattgaaagtcataattgctggtgcaggtttgggtggtttgtcaactgctaagtatctggcggatgcaggtcataaaccaatattattagaagcgagagat

SEQ ID NO: 82 - DNA, 200 bp, Abutilon theophrasti
atctctcgcttctaataatattggtttatgacctgcatccgccagatacttagcagttgacaaaccacccaaacctgcaccagcaattatgactttcaatggcttagttggacggggagcagaacgaaaagaagcagatagagaagcagcctccaaaaagttagcagtactctcaagctctggccttggataatctatgc

SEQ ID NO: 83 - DNA, 200 bp, Abutilon theophrasti
accaatattattagaagcgagagatgttctaggtggaaaggtggctgcatggaaagatgatgatggagattggtatgagacaggcttacatatattctttggggcttacccaaatgtgcaaaacttgtttggtgaacttggcatcaatgatcggctgcaatggaaggagcattctatgatatttgcgatgccaaataaac

SEQ ID NO: 84 - DNA, 200 bp, Abutilon theophrasti
gtttatttggcatcgcaaatatcatagaatgctccttccattgcagccgatcattgatgccaagttcaccaaacaagttttgcacatttgggtaagccccaaagaatatatgtaagcctgtctcataccaatctccatcatcatctttccatgcagccacctttccacctagaacatctctcgcttctaataatattggt

SEQ ID NO: 85 - DNA, 200 bp, Abutilon theophrasti
atgatatttgcgatgccaaataaacctggagagttcagtcgatttgattttccagaagttctacctgcacccttaaatgggatatgggccattttgaagaacaatgaaatgctgacttggccagagaaagtgaaatttgcaataggactgctacccgcaattgttggtggacaagcttatgttgaggcccaagatggttt

SEQ ID NO: 86 - DNA, 200 bp, Abutilon theophrasti
aaaccatcttgggcctcaacataagcttgtccaccaacaattgcgggtagcagtcctattgcaaatttcactttctctggccaagtcagcatttcattgttcttcaaaatggcccatatcccatttaagggtgcaggtagaacttctggaaaatcaaatcgactgaactctccaggtttatttggcatcgcaaatatcat

SEQ ID NO: 87 - DNA, 200 bp, Abutilon theophrasti
cttatgttgaggcccaagatggtttatctgttaaagagtggatgagaaagcagggggtacctgatcgtgtgaccgaggaggtgtttattgccatgtcaaaggctctaaacttcattaacccagatgaactttcaatgcaatgtatattgattgctttgaatcgatttcttcaggagaaacatggatcaaagatggcattc

SEQ ID NO: 88 - DNA, 200 bp, Abutilon theophrasti
gaatgccatctttgatccatgtttctcctgaagaaatcgattcaaagcaatcaatatacattgcattgaaagttcatctgggttaatgaagtttagagcctttgacatggcaataaacacctcctcggtcacacgatcaggtaccccctgctttctcatccactctttaacagataaaccatcttgggcctcaacataag

SEQ ID NO: 89 - DNA, 200 bp, Abutilon theophrasti
gaaacatggatcaaagatggcattcttggatggcaaccctccagagaggctttgcatgccaatcgttaatcatattgagtcattaggtggtgaggtccggcttaactcacgaataaagaaaatagagctcaatgatgatggaactgtgagtagttttcttttaactaatggcagtacaattgaaggagatgcttatgtag

SEQ ID NO: 90 - DNA, 200 bp, Abutilon theophrasti
ctacataagcatctccttcaattgtactgccattagttaaaagaaaactactcacagttccatcatcattgagctctattttctttattcgtgagttaagccggacctcaccacctaatgactcaatatgattaacgattggcatgcaaagcctctctggagggttgccatccaagaatgccatctttgatccatgtttc

SEQ ID NO: 91 - DNA, 200 bp, Abutilon theophrasti
acaattgaaggagatgcttatgtagttgcaactccagttgatatcttcaagttacttttgcctgaagactggagagcgatttcttacttcaagaagttagagaaattagtaggagttccagttatcaatgttcacatctggttcgataggaaattgaagaacaccgctgataatcttctcttcagcagaagttctcttct

SEQ ID NO: 92 - DNA, 200 bp, Abutilon theophrasti
agaagagaacttctgctgaagagaagattatcagcggtgttcttcaatttcctatcgaaccagatgtgaacattgataactggaactcctactaatttctctaacttcttgaagtaagaaatcgctctccagtcttcaggcaaaagtaacttgaagatatcaactggagttgcaactacataagcatctccttcaattgt

SEQ ID NO: 93 - DNA, 200 bp, Abutilon theophrasti
ttctcttcagcagaagttctcttctaagtgtttatgccgacatgtctgtaacgtgtaaggaatactacaatccaaaccaatccatgttggagttggtttttgctccggcagaagaatgggttgcacgtagtgactcagaaattattgatgctacaatgaaggaacttgcaaagctctttcctgatgaaatatctgcagat

SEQ ID NO: 94 - DNA, 200 bp, Abutilon theophrasti
atctgcagatatttcatcaggaaagagctttgcaagttccttcattgtagcatcaataatttctgagtcactacgtgcaacccattcttctgccggagcaaaaaccaactccaacatggattggtttggattgtagtattccttacacgttacagacatgtcggcataaacacttagaagagaacttctgctgaagagaa

SEQ ID NO: 95 - DNA, 200 bp, Abutilon theophrasti
ctttcctgatgaaatatctgcagatcagagtaaagcaaaaatcgtgaagtaccatgtcgttaaaacaccaagatctgtatataaaactgttccgaattgtgaaccctgccgccccttgcaaagatctccgatacaaggattctatctagcaggtgattacacaaagcaaaagtatttagcttcaatggaaggtgctgtcc

SEQ ID NO: 96 - DNA, 200 bp, Abutilon theophrasti
ggacagcaccttccattgaagctaaatacttttgctttgtgtaatcacctgctagatagaatccttgtatcggagatctttgcaaggggcggcagggttcacaattcggaacagttttatatacagatcttggtgttttaacgacatggtacttcacgatttttgctttactctgatctgcagatatttcatcaggaaag

SEQ ID NO: 97 - DNA, 200 bp, Abutilon theophrasti
ttagcttcaatggaaggtgctgtcctctcagggaagctttgtgcacagtctattgtacaggattacgagttgcttagctactttgggacaaagaaggttgacagtggcaagcatcaactgatgtcgtttaaatcgaggtaaacagttcacaagttaccgaggatcatctgctaatccattgtttaaggccacttagatta

SEQ ID NO: 98 - DNA, 200 bp, Abutilon theophrasti
taatctaagtggccttaaacaatggattagcagatgatcctcggtaacttgtgaactgtttacctcgatttaaacgacatcagttgatgcttgccactgtcaaccttctttgtcccaaagtagctaagcaactcgtaatcctgtacaatagactgtgcacaaagcttccctgagaggacagcaccttccattgaagctaa

SEQ ID NO: 99 - DNA, 200 bp, Amaranthus chlorostachys
gattcagttggaccagagtggaagcgtgaagagttttttgctaaataacgggagggaaatacgaggagatgcctatgtttttgccaccccagttgacatcttgaagctgttactacccgatacttggaaggaaatctcatacttcaaaaagcttgagaaattagtgggcgttcctgtgattaatgttcacatatggtttg

SEQ ID NO: 100 - DNA, 200 bp, Amaranthus chlorostachys
caaaccatatgtgaacattaatcacaggaacgcccactaatttctcaagctttttgaagtatgagatttccttccaagtatcgggtagtaacagcttcaagatgtcaactggggtggcaaaaacataggcatctcctcgtatttccctcccgttatttagcaaaaaactcttcacgcttccactctggtccaactgaatc

SEQ ID NO: 101 - DNA, 200 bp, Amaranthus chlorostachys
gtgattaatgttcacatatggtttgacagaaaattaaagaatacatatgaccatctactcttcagcaggagtcctcttttgagtgtctacgctgatatgtcggagacatgcaaggaatataaggatcctaatagatccatgctggagctggtttttgcacccgcggaggaatggatttcacgaagcgacactgatattat

SEQ ID NO: 102 - DNA, 200 bp, Amaranthus chlorostachys
ataatatcagtgtcgcttcgtgaaatccattcctccgcgggtgcaaaaaccagctccagcatggatctattaggatccttatattccttgcatgtctccgacatatcagcgtagacactcaaaagaggactcctgctgaagagtagatggtcatatgtattctttaattttctgtcaaaccatatgtgaacattaatcac

SEQ ID NO: 103 - DNA, 200 bp, Amaranthus graecizans
gaacaaactttgtgggggggtggtgaaaaatgagtcattttggatatgcttgtgctactcaatccacatcaagatatgttcttttaggaaattcaaataaccccacttcagtttcatctattggaagtgattttttgggtcattctgtgagaaatttcagtgttagtaaagtttatggtggaaagcaaagaaatgggcac

SEQ ID NO: 104 - DNA, 200 bp, Amaranthus graecizans
gtgcccatttctttgctttccaccataaactttactaacactgaaatttctcacagaatgacccaaaaaatcacttccaatagatgaaactgaagtggggttatttgaatttcctaaaagaacatatcttgatgtggattgagtagcacaagcatatccaaaatgactcatttttcaccacccccccacaaagtttgttc

SEQ ID NO: 105 - DNA, 200 bp, Amaranthus graecizans
tggtggaaagcaaagaaatgggcactgccctttaaaggttgtttgtatagattatcctaggccagagcttgaaagtacatccaatttcttggaagccgcctacttatcttctacttttcggaattcgcctcgtcctcagaagccattagaagttgtaattgccggagcaggtttggctggtctatccacggcaaagtatt

SEQ ID NO: 106 - DNA, 200 bp, Amaranthus graecizans
aatactttgccgtggatagaccagccaaacctgctccggcaattacaacttctaatggcttctgaggacgaggcgaattccgaaaagtagaagataagtaggcggcttccaagaaattggatgtactttcaagctctggcctaggataatctatacaaacaacctttaaagggcagtgcccatttctttgctttccacca

SEQ ID NO: 107 - DNA, 200 bp, Amaranthus graecizans
gctggtctatccacggcaaagtatttagctgatgcaggtcacaaacccatattgctggaagcacgagatgttttaggaggaaaggttgcagcatggaaggatgaggatggtgactggtatgagactgggctacatatattctttggggcatatccaaatatccaaaatctatttggagaacttggtataaatgaccgatt

SEQ ID NO: 108 - DNA, 200 bp, Amaranthus graecizans
aatcggtcatttataccaagttctccaaatagattttggatatttggatatgccccaaagaatatatgtagcccagtctcataccagtcaccatcctcatccttccatgctgcaacctttcctcctaaaacatctcgtgcttccagcaatatgggtttgtgacctgcatcagctaaatactttgccgtggatagaccagc

SEQ ID NO: 109 - DNA, 200 bp, Amaranthus graecizans
gagaacttggtataaatgaccgattgcaatggaaggagcactctatgatttttgcaatgcctagcaaacccggtgaattcagtcgctttgattttctcgaagtcctgcctgcaccattgaatggcatatgggcaatcctaaggaataatgaaatgctaacctggccagaaaaaatcaagtttgccattggcttgttgcct

SEQ ID NO: 110 - DNA, 200 bp, Amaranthus graecizans
aggcaacaagccaatggcaaacttgattttttctggccaggttagcatttcattattccttaggattgcccatatgccattcaatggtgcaggcaggacttcgagaaaatcaaagcgactgaattcaccgggtttgctaggcattgcaaaaatcatagagtgctccttccattgcaatcggtcatttataccaagttctc

SEQ ID NO: 111 - DNA, 200 bp, Amaranthus graecizans
caagtttgccattggcttgttgcctgctatggctggcggacagtcatatgttgaggcacaagatggtttgagtgtccaagagtggatgagaaagcaaggagtacccgatcgtgtaactgatgaagtatttattgccatgtcaaaggcactgaacttcataaatcccgatgaactttcgatgcagtgcatcttgatagctc

SEQ ID NO: 112 - DNA, 200 bp, Amaranthus graecizans
gagctatcaagatgcactgcatcgaaagttcatcgggatttatgaagttcagtgcctttgacatggcaataaatacttcatcagttacacgatcgggtactccttgctttctcatccactcttggacactcaaaccatcttgtgcctcaacatatgactgtccgccagccatagcaggcaacaagccaatggcaaacttg

SEQ ID NO: 113 - DNA, 200 bp, Amaranthus graecizans
tcgatgcagtgcatcttgatagctcttaaccgattcctacaggagaaacatggttctaagatggcctttctagacggaaaccctccagagaggctttgcatgcctattgttaagcacattgagtcactaggtggtgaagttcaacttaactctcgtatacaaaagattgagttggatcagagtggaagcgtgaagagttt

SEQ ID NO: 114 - DNA, 200 bp, Amaranthus graecizans
aaactcttcacgcttccactctgatccaactcaatcttttgtatacgagagttaagttgaacttcaccacctagtgactcaatgtgcttaacaataggcatgcaaagcctctctggagggtttccgtctagaaaggccatcttagaaccatgtttctcctgtaggaatcggttaagagctatcaagatgcactgcatcga

SEQ ID NO: 115 - DNA, 200 bp, Amaranthus graecizans
atcagagtggaagcgtgaagagttttttgctaaataacgggagggaaatacgaggagatgcctatgtttttgccaccccagttgacatcttgaagctgttactacctgatacttggaaggaaatctcatacttcaaaaagcttgagaaattagtgggcgttcctgtgattaatgttcacatatggtttgacagaaaatta

SEQ ID NO: 116 - DNA, 200 bp, Amaranthus graecizans
taattttctgtcaaaccatatgtgaacattaatcacaggaacgcccactaatttctcaagctttttgaagtatgagatttccttccaagtatcaggtagtaacagcttcaagatgtcaactggggtggcaaaaacataggcatctcctcgtatttccctcccgttatttagcaaaaaactcttcacgcttccactctgat

SEQ ID NO: 117 - DNA, 200 bp, Amaranthus graecizans
tcacatatggtttgacagaaaattaaagaatacgtatgaccatctactcttcagcaggagtcctcttttgagtgtctatgctgatatgtcagagacatgcaaggagtataaggatccaaatagatccatgctggaacttgtttttgcacccgcggaggaatggatttcacgaagcgacactgatattatcgaggcaacaa

SEQ ID NO: 118 - DNA, 200 bp, Amaranthus graecizans
ttgttgcctcgataatatcagtgtcgcttcgtgaaatccattcctccgcgggtgcaaaaacaagttccagcatggatctatttggatccttatactccttgcatgtctctgacatatcagcatagacactcaaaagaggactcctgctgaagagtagatggtcatacgtattctttaattttctgtcaaaccatatgtga

SEQ ID NO: 119 - DNA, 200 bp, Amaranthus graecizans
gacactgatattatcgaggcaacaatgaatgagcttgccaagcttttcccggatgaaatcgctgctgacgggagcaaggccaagatccttaaatatcatgtcgtcaaaactccaaggtcggtttataagacagtaccggattgtgagccttgtcggccgctgcaaagatcaccaatagagggattctatttagctggtga

SEQ ID NO: 120 - DNA, 200 bp, Amaranthus graecizans
tcaccagctaaatagaatccctctattggtgatctttgcagcggccgacaaggctcacaatccggtactgtcttataaaccgaccttggagttttgacgacatgatatttaaggatcttggccttgctcccgtcagcagcgatttcatccgggaaaagcttggcaagctcattcattgttgcctcgataatatcagtgtc

SEQ ID NO: 121 - DNA, 200 bp, Amaranthus graecizans
tagagggattctatttagctggtgattacacaaaacaaaaatatttggcttctatggaaggtgctgtcttatctgggaagctttgtgcacaggctattgtacaggattatgatctgctgagttctcgagcacaaagagaattggcggcgagaagcaatgtataaccctggattgcttcgacatccgccattgattttcat

SEQ ID NO: 122 - DNA, 200 bp, Amaranthus graecizans
atgaaaatcaatggcggatgtcgaagcaatccagggttatacattgcttctcgccgccaattctctttgtgctcgagaactcagcagatcataatcctgtacaatagcctgtgcacaaagcttcccagataagacagcaccttccatagaagccaaatatttttgttttgtgtaatcaccagctaaatagaatccctcta

SEQ ID NO: 123 - DNA, 200 bp, Amaranthus graecizans
ttcgacatccgccattgattttcattcgagatcaggattgggaatctgatcagtcatcgaataatgatcggctgtaaacaaaattatgggggttgcataccggtgctcgtcaagttgacgtataaattctccagaatgaagatttatttgtaatgatatctattaaatattttaatttattttctgatagaaatatgtat

SEQ ID NO: 124 - DNA, 200 bp, Amaranthus graecizans
atacatatttctatcagaaaataaattaaaatatttaatagatatcattacaaataaatcttcattctggagaatttatacgtcaacttgacgagcaccggtatgcaacccccataattttgtttacagccgatcattattcgatgactgatcagattcccaatcctgatctcgaatgaaaatcaatggcggatgtcgaa

SEQ ID NO: 125 - DNA, 200 bp, Amaranthus hybridus
ctaaattccaacaatttggtccatttttcttgttctttcagtttcacataccctcttatcaatctatatccaaaactatttcattttccaaactcttttaaacccaaaaatcaaaacttttgattgaagaacaaactttggggttttggaaaatgagtcattttggatatgcttgtgctactcaatccacatcaagatat

SEQ ID NO: 126 - DNA, 200 bp, Amaranthus hybridus
atatcttgatgtggattgagtagcacaagcatatccaaaatgactcattttccaaaaccccaaagtttgttcttcaatcaaaagttttgatttttgggtttaaaagagtttggaaaatgaaatagttttggatatagattgataagagggtatgtgaaactgaaagaacaagaaaaatggaccaaattgttggaatttag

SEQ ID NO: 127 - DNA, 200 bp, Amaranthus hybridus
tgctactcaatccacatcaagatatgttcttttaggaaattcaaataaccacacttcaatttcatctattggaagtgattttttgggtcattctgtgagaaatttcagttttagtaaagtttatgggggaaagcaaagaaatgggcactgccctttaaaggttgtttgtatggattatcctaggcctgagcttgaaagta

SEQ ID NO: 128 - DNA, 200 bp, Amaranthus hybridus
tactttcaagctcaggcctaggataatccatacaaacaacctttaaagggcagtgcccatttctttgctttcccccataaactttactaaaactgaaatttctcacagaatgacccaaaaaatcacttccaatagatgaaattgaagtgtggttatttgaatttcctaaaagaacatatcttgatgtggattgagtagca

SEQ ID NO: 129 - DNA, 200 bp, Amaranthus hybridus
tatcctaggcctgagcttgaaagtacatccaatttcttggaagctgcctacttatcttctacttttcggaattcgcctcgtcctcagaagccattagaagttgtaattgctggagcaggtttggctggtctatccacggcaaagtatttagctgatgcaggtcacaaacccatattgctggaagcacgagatgttttagg

SEQ ID NO: 130 - DNA, 200 bp, Amaranthus hybridus
cctaaaacatctcgtgcttccagcaatatgggtttgtgacctgcatcagctaaatactttgccgtggatagaccagccaaacctgctccagcaattacaacttctaatggcttctgaggacgaggcgaattccgaaaagtagaagataagtaggcagcttccaagaaattggatgtactttcaagctcaggcctaggata

SEQ ID NO: 131 - DNA, 200 bp, Amaranthus hybridus
tgctggaagcacgagatgttttaggaggaaaggttgcagcgtggaaggatgaggatggtgactggtacgagactgggctacatatattctttggggcttatccaaatatccaaaatctatttggagaacttggtataaatgatcgattgcaatggaaggagcactctatgatttttgcaatgcctagcaagcctggtgaa

SEQ ID NO: 132 - DNA, 200 bp, Amaranthus hybridus
ttcaccaggcttgctaggcattgcaaaaatcatagagtgctccttccattgcaatcgatcatttataccaagttctccaaatagattttggatatttggataagccccaaagaatatatgtagcccagtctcgtaccagtcaccatcctcatccttccacgctgcaacctttcctcctaaaacatctcgtgcttccagca

SEQ ID NO: 133 - DNA, 200 bp, Amaranthus hybridus
tgcaatgcctagcaagcctggtgaattcagtcgctttgattttcccgaagtcctgcctgcaccattaaatggcatatgggcaatcctaaggaataatgaaatgctaacctggccagaaaaaatcaagtttgccattggcttgttgcctgctatggctggcggacagtcatatgttgaagcacaagacggtttgagtgtcc

SEQ ID NO: 134 - DNA, 200 bp, Amaranthus hybridus
ggacactcaaaccgtcttgtgcttcaacatatgactgtccgccagccatagcaggcaacaagccaatggcaaacttgattttttctggccaggttagcatttcattattccttaggattgcccatatgccatttaatggtgcaggcaggacttcgggaaaatcaaagcgactgaattcaccaggcttgctaggcattgca

SEQ ID NO: 135 - DNA, 200 bp, Amaranthus hybridus
gaagcacaagacggtttgagtgtccaagagtggatgagaaaacaaggagtacccgatcgtgtaactgatgaagtatttattgccatgtcaaaggcactgaacttcataaatcccgatgaactttcaatgcagtgcatcttgattgctctgaaccgattcctgcaggagaaacatggttctaagatggccttcctagacgg

SEQ ID NO: 136 - DNA, 200 bp, Amaranthus hybridus
ccgtctaggaaggccatcttagaaccatgtttctcctgcaggaatcggttcagagcaatcaagatgcactgcattgaaagttcatcgggatttatgaagttcagtgcctttgacatggcaataaatacttcatcagttacacgatcgggtactccttgttttctcatccactcttggacactcaaaccgtcttgtgcttc

SEQ ID NO: 137 - DNA, 200 bp, Amaranthus hybridus
gttctaagatggccttcctagacggaaaccctccagagaggctgtgcatgcctattgttaagcacattgagtcactaggtggtgaagttaaacttaactctcgtatacaaaagattcagttggatcagagtggaagcgtgaagagttttttgctaaataacgggagggaaatacgaggagatgcctatgtttttgccacc

SEQ ID NO: 138 - DNA, 200 bp, Amaranthus hybridus
ggtggcaaaaacataggcatctcctcgtatttccctcccgttatttagcaaaaaactcttcacgcttccactctgatccaactgaatcttttgtatacgagagttaagtttaacttcaccacctagtgactcaatgtgcttaacaataggcatgcacagcctctctggagggtttccgtctaggaaggccatcttagaac

SEQ ID NO: 139 - DNA, 200 bp, Amaranthus hybridus
aggagatgcctatgtttttgccaccccagttgacatcttgaagctgttactacccgatacttggaaggaaatctcatacttcaaaaagcttgaaaaattagtgggcgttcctgtgattaatgttcacatatggtttgacagaaaattaaagaatacatatgaccatttactcttcagcagaagtcctcttttgagtgtct

SEQ ID NO: 140 - DNA, 200 bp, Amaranthus hybridus
agacactcaaaagaggacttctgctgaagagtaaatggtcatatgtattctttaattttctgtcaaaccatatgtgaacattaatcacaggaacgcccactaatttttcaagctttttgaagtatgagatttccttccaagtatcgggtagtaacagcttcaagatgtcaactggggtggcaaaaacataggcatctcct

SEQ ID NO: 141 - DNA, 200 bp, Amaranthus hybridus
agcagaagtcctcttttgagtgtctatgctgatatgtcggagacatgcaaggaatataaggatcctaatagatccatgctggaactggtttttgcacccgcggaggaatggatttcacgtagcgacactgatattatagaggcaacaatgaaagagcttgccaagcttttccccgatgaaattgctgccgatgggagcaa

SEQ ID NO: 142 - DNA, 200 bp, Amaranthus hybridus
ttgctcccatcggcagcaatttcatcggggaaaagcttggcaagctctttcattgttgcctctataatatcagtgtcgctacgtgaaatccattcctccgcgggtgcaaaaaccagttccagcatggatctattaggatccttatattccttgcatgtctccgacatatcagcatagacactcaaaagaggacttctgct

SEQ ID NO: 143 - DNA, 200 bp, Amaranthus hybridus
atgaaattgctgccgatgggagcaaggccaagatcctcaaatatcatgtcgtcaaaactccaaggtcggtttataagactgtaccggattgtgaaccttgtcggccgctgcaaagatcaccaatagagggtttctatttagctggtgattacacaaaacaaaaatatttggcttctatggaaggtgctgtcttatctggg

SEQ ID NO: 144 - DNA, 200 bp, Amaranthus hybridus
cccagataagacagcaccttccatagaagccaaatatttttgttttgtgtaatcaccagctaaatagaaaccctctattggtgatctttgcagcggccgacaaggttcacaatccggtacagtcttataaaccgaccttggagttttgacgacatgatatttgaggatcttggccttgctcccatcggcagcaatttcat

SEQ ID NO: 145 - DNA, 200 bp, Amaranthus lividus
gggttttggaaaatgagtcattttggatatgcttgtgctactcaatccacatcaagatatgttcttttgggaaattcaaataaccccacttcaatttcatctattggaagtgattttttgggtcattctgtgagaaatttcagtgttagtaaagtttatggggcaaagcaaagaaatgggcactgccctttaaaggttgt

SEQ ID NO: 146 - DNA, 200 bp, Amaranthus lividus
acaacctttaaagggcagtgcccatttctttgctttgccccataaactttactaacactgaaatttctcacagaatgacccaaaaaatcacttccaatagatgaaattgaagtggggttatttgaatttcccaaaagaacatatcttgatgtggattgagtagcacaagcatatccaaaatgactcattttccaaaaccc

SEQ ID NO: 147 - DNA, 200 bp, Amaranthus lividus
atgggcactgccctttaaaggttgtttgtatagattatcctaggcctgagcttgaaagtacatccaatttcttggaagccgcctacttatcttctacttttcggaattcgcctcgtcctcagaagccattagaagttgtaattgccggagcaggtttggctggtctatccacagcaaagtatttagctgatgcaggtcac

SEQ ID NO: 148 - DNA, 200 bp, Amaranthus lividus
gtgacctgcatcagctaaatactttgctgtggatagaccagccaaacctgctccggcaattacaacttctaatggcttctgaggacgaggcgaattccgaaaagtagaagataagtaggcggcttccaagaaattggatgtactttcaagctcaggcctaggataatctatacaaacaacctttaaagggcagtgcccat

SEQ ID NO: 149 - DNA, 200 bp, Amaranthus lividus
aaagtatttagctgatgcaggtcacaaacccatattgttggaagcacgagatgttttaggaggaaaggttgcagcgtggaaggatgaggatggtgactggtatgagactgggctacatatattctttggggcatatccaaatatccaaaatctatttggagaacttggtataaatgaccgactgcaatggaaggagcact

SEQ ID NO: 150 - DNA, 200 bp, Amaranthus lividus
agtgctccttccattgcagtcggtcatttataccaagttctccaaatagattttggatatttggatatgccccaaagaatatatgtagcccagtctcataccagtcaccatcctcatccttccacgctgcaacctttcctcctaaaacatctcgtgcttccaacaatatgggtttgtgacctgcatcagctaaatacttt

SEQ ID NO: 151 - DNA, 200 bp, Amaranthus lividus
gaccgactgcaatggaaggagcactctatgatttttgcaatgcctagcaagcccggtgaattcagtcgctttgattttccagaaatcctgcctgcaccattaaatggcatatgggcaatcctaaggaataatgaaatgctaacctggccagaaaaaatcaagtttgccattggcttgttgcctgctatggcgggcggaca

SEQ ID NO: 152 - DNA, 200 bp, Amaranthus lividus
tgtccgcccgccatagcaggcaacaagccaatggcaaacttgattttttctggccaggttagcatttcattattccttaggattgcccatatgccatttaatggtgcaggcaggatttctggaaaatcaaagcgactgaattcaccgggcttgctaggcattgcaaaaatcatagagtgctccttccattgcagtcggtc

SEQ ID NO: 153 - DNA, 200 bp, Amaranthus lividus
tgttgcctgctatggcgggcggacagtcatatgttgaagcacaagatggtttgagtgttcaagagtggatgagaaaacaaggagtacctgatcgtgtaactgatgaagtgtttattgccatgtcaaaggcactgaacttcataaatcccgatgaactttcaatgcagtgcatcttgattgctctgaaccgattcctgcag

SEQ ID NO: 154 - DNA, 200 bp, Amaranthus lividus
ctgcaggaatcggttcagagcaatcaagatgcactgcattgaaagttcatcgggatttatgaagttcagtgcctttgacatggcaataaacacttcatcagttacacgatcaggtactccttgttttctcatccactcttgaacactcaaaccatcttgtgcttcaacatatgactgtccgcccgccatagcaggcaaca

SEQ ID NO: 155 - DNA, 200 bp, Amaranthus lividus
gattgctctgaaccgattcctgcaggagaaacatggttctaagatggccttcctagacggaaaccctccagagaggctgtgcatgcctattgttaagcacatcgagtcactaggtggtgaagttaaacttaactctcggatacaaaagattcagttggaccagagtggaagcgtgaagagtttttgctaaataacgggag

SEQ ID NO: 156 - DNA, 200 bp, Amaranthus lividus
ctcccgttatttagcaaaaactcttcacgcttccactctggtccaactgaatcttttgtatccgagagttaagtttaacttcaccacctagtgactcgatgtgcttaacaataggcatgcacagcctctctggagggtttccgtctaggaaggccatcttagaaccatgtttctcctgcaggaatcggttcagagcaatc

SEQ ID NO: 157 - DNA, 200 bp, Amaranthus lividus
aagagtttttgctaaataacgggagggaaatacgaggagatgcctatgttttgccaccccagttgacatcttgaagctgttactacccgatacttggaaggaaatctcatacttcaaaaagcttgagaaattagtgggcgttcctgtgattaatgttcacatatggtttgacagaaaattaaagaatacatatgaccatc

SEQ ID NO: 158 - DNA, 200 bp, Amaranthus lividus
gatggtcatatgtattctttaattttctgtcaaaccatatgtgaacattaatcacaggaacgcccactaatttctcaagctttttgaagtatgagatttccttccaagtatcgggtagtaacagcttcaagatgtcaactggggtggcaaaacataggcatctcctcgtatttccctcccgttatttagcaaaaactctt

SEQ ID NO: 159 - DNA, 200 bp, Amaranthus lividus
aaattaaagaatacatatgaccatctactcttcagcaggagtcctcttttgagtgtctacgctgatatgtcggagacatgcaaggaatataaggatcctaatagatccatgctggaactggtttttgcacccgcggaggaatggatttcacgaagcgacactgatattatcgaggcaacaatgaaagagcttgccaagct

SEQ ID NO: 160 - DNA, 200 bp, Amaranthus lividus
agcttggcaagctctttcattgttgcctcgataatatcagtgtcgcttcgtgaaatccattcctccgcgggtgcaaaaaccagttccagcatggatctattaggatccttatattccttgcatgtctccgacatatcagcgtagacactcaaaagaggactcctgctgaagagtagatggtcatatgtattctttaattt

SEQ ID NO: 161 - DNA, 200 bp, Amaranthus lividus
caacaatgaaagagcttgccaagcttttcccggatgaaatcgctgccgatggaagcaaggccaagatccttaagtatcatgttgtgaaaacaccaaggtcggtttataagactgtaccggattgtgaaccttgtcggccgctgcaaagatcaccaatagagggtttctatttagctggtgattacacaaaacaaaatatt

SEQ ID NO: 162 - DNA, 200 bp, Amaranthus lividus
aatattttgttttgtgtaatcaccagctaaatagaaaccctctattggtgatctttgcagcggccgacaaggttcacaatccggtacagtcttataaaccgaccttggtgttttcacaacatgatacttaaggatcttggccttgcttccatcggcagcgatttcatccgggaaaagcttggcaagctctttcattgttg

SEQ ID NO: 163 - DNA, 200 bp, Amaranthus lividus
tggtgattacacaaaacaaaatatttggcttctatggaaggtgctgtcttatctgggaagctttgtgcacaggctatcgtacaggattatgatctgctgagttctcgagcacaaagagaattggcggcgacaagcaatgtataaccctaaattgcttcgacatccgccatcgactttcattcgagatctggattgggaat

SEQ ID NO: 164 - DNA, 200 bp, Amaranthus lividus
attcccaatccagatctcgaatgaaagtcgatggcggatgtcgaagcaatttagggttatacattgcttgtcgccgccaattctctttgtgctcgagaactcagcagatcataatcctgtacgatagcctgtgcacaaagcttcccagataagacagcaccttccatagaagccaaatattttgttttgtgtaatcacca

SEQ ID NO: 165 - DNA, 200 bp, Amaranthus palmeri
acccataaggagagggcggtcacaagagtccttcggttaagaggagtcttcaaggataagacctgcaaatatccgaaaacctagtacctatggactataattgtgttggataaaataacaattagttcatattggactataattttaccctagtgcctatggaagattggggaaataatttaatcatactccttttttat

SEQ ID NO: 166 - DNA, 200 bp, Amaranthus palmeri
ataaaaaaggagtatgattaaattatttccccaatcttccataggcactagggtaaaattatagtccaatatgaactaattgttattttatccaacacaattatagtccataggtactaggttttcggatatttgcaggtcttatccttgaagactcctcttaaccgaaggactcttgtgaccgccctctccttatgggt

SEQ ID NO: 167 - DNA, 200 bp, Amaranthus palmeri
taatttaatcatactccttttttattcatcttttttatttattctcatgctatttctttcacaatgtttcaattacctcacttgcacttctactggcctttatttcaataatttaactttttttcacccttcaatatttacaatcaatccaagcgagcactaagaaaaaaaacatttggcttgatatatactaatttacc

SEQ ID NO: 168 - DNA, 200 bp, Amaranthus palmeri
ggtaaattagtatatatcaagccaaatgttttttttcttagtgctcgcttggattgattgtaaatattgaagggtgaaaaaaagttaaattattgaaataaaggccagtagaagtgcaagtgaggtaattgaaacattgtgaaagaaatagcatgagaataaataaaaaagatgaataaaaaaggagtatgattaaatta

SEQ ID NO: 169 - DNA, 200 bp, Amaranthus palmeri
ttggcttgatatatactaatttaccataataaaatccaaacctgccaaaaaaacatttagttattaaaaatgctatgaaaatagtctttttttttctcaagtgaagttctgtaaattaaaaaaagaaaagcaaagtaaattacctggaccgttgttgcggtggaggaaagttccaacgggacttttgatcttagtaccaa

SEQ ID NO: 170 - DNA, 200 bp, Amaranthus palmeri
ttggtactaagatcaaaagtcccgttggaactttcctccaccgcaacaacggtccaggtaatttactttgcttttctttttttaatttacagaacttcacttgagaaaaaaaaagactattttcatagcatttttaataactaaatgtttttttggcaggtttggattttattatggtaaattagtatatatcaagccaa

SEQ ID NO: 171 - DNA, 200 bp, Amaranthus palmeri
acgggacttttgatcttagtaccaaacaccggttcaatgaagttcaagaataccgactcatcattgttggctaaaaccacagcctgaagtgctgaatcagctacaccaagcagatcatccgcactaaactcagcaaactcatgaaacccacttatctttcttacatactcccacaccgggtttaactcttccacacaact

SEQ ID NO: 172 - DNA, 200 bp, Amaranthus palmeri
agttgtgtggaagagttaaacccggtgtgggagtatgtaagaaagataagtgggtttcatgagtttgctgagtttagtgcggatgatctgcttggtgtagctgattcagcacttcaggctgtggttttagccaacaatgatgagtcggtattcttgaacttcattgaaccggtgtttggtactaagatcaaaagtcccgt

SEQ ID NO: 173 - DNA, 200 bp, Amaranthus palmeri
ccgggtttaactcttccacacaacttgcagcatggtctattccctttatcccaaactcctctactcttccaacctctactcttgcaaacttagcaagccgccacaaattaccccactctttttcattttcagatgaatggctcacaaatcgtaggactacgtcattatacagaatgacttccgcaagcatcgtgtgtccg

SEQ ID NO: 174 - DNA, 200 bp, Amaranthus palmeri
cggacacacgatgcttgcggaagtcattctgtataatgacgtagtcctacgatttgtgagccattcatctgaaaatgaaaaagagtggggtaatttgtggcggcttgctaagtttgcaagagtagaggttggaagagtagaggagtttgggataaagggaatagaccatgctgcaagttgtgtggaagagttaaacccgg

SEQ ID NO: 175 - DNA, 200 bp, Amaranthus palmeri
gacttccgcaagcatcgtgtgtccgtcttcaagcaggacaggcggggctgacggattagctcctgcagcaacgctaatcctaaaggcggattcagcgttctccacttcaagggccacagcgcgaacaccaagcccatgagaacacacaaaagaggcgtgcgcactgtggtcaaatgtaggaattgaagcagtgttgagct

SEQ ID NO: 176 - DNA, 200 bp, Amaranthus palmeri
agctcaacactgcttcaattcctacatttgaccacagtgcgcacgcctcttttgtgtgttctcatgggcttggtgttcgcgctgtggcccttgaagtggagaacgctgaatccgcctttaggattagcgttgctgcaggagctaatccgtcagccccgcctgtcctgcttgaagacggacacacgatgcttgcggaagtc

SEQ ID NO: 177 - DNA, 200 bp, Amaranthus palmeri
gtaggaattgaagcagtgttgagcttagatgaagcagagtaaggagccgtgaatacgaaacaaaggtcgccactacgtaagacgtaggaggcatgtacaaggttgcctgtcgagagatcggatttggcaaccaaaggcatgccaagccctaacgaaaataaaaggctagtgttggttgcatcaccacaccagaactcaat

SEQ ID NO: 178 - DNA, 200 bp, Amaranthus palmeri
attgagttctggtgtggtgatgcaaccaacactagccttttattttcgttagggcttggcatgcctttggttgccaaatccgatctctcgacaggcaaccttgtacatgcctcctacgtcttacgtagtggcgacctttgtttcgtattcacggctccttactctgcttcatctaagctcaacactgcttcaattcctac

SEQ ID NO: 179 - DNA, 200 bp, Amaranthus palmeri
agcttggtataaatgagcgattacaatgaaaggagcactctatgatttttgctatgccaagcaatcctggtattttcagtcttttttttattgaagtcctcccaggctccaacaacatttaacgtttagtttggtaataaaattcgcaaaatgtctgtatttagcgaaagtcaaactactcctaatgactttcacgagtc

SEQ ID NO: 180 - DNA, 200 bp, Amaranthus palmeri
gactcgtgaaagtcattaggagtagtttgactttcgctaaatacagacattttgcgaattttattaccaaactaaacgttaaatgttgttggagcctgggaggacttcaataaaaaaaagactgaaaataccaggattgcttggcatagcaaaaatcatagagtgctcctttcattgtaatcgctcatttataccaagct

SEQ ID NO: 181 - DNA, 200 bp, Amaranthus palmeri
agggataaatgataaagattgattcattttttttaaatgaataatttgtttttttgtatgatgcaggttgtttgtatagattatcctaggccagagcttgaaagtacatccaatttcttggaagccgcctacttatcttctacttttcggaattcgcctcgtcctcagaagccattagaagttgtaattgctggagcagg

SEQ ID NO: 182 - DNA, 200 bp, Amaranthus palmeri
cctgctccagcaattacaacttctaatggcttctgaggacgaggcgaattccgaaaagtagaagataagtaggcggcttccaagaaattggatgtactttcaagctctggcctaggataatctatacaaacaacctgcatcatacaaaaaaacaaattattcatttaaaaaaaatgaatcaatctttatcatttatccct

SEQ ID NO: 183 - DNA, 200 bp, Amaranthus palmeri
tagaagttgtaattgctggagcaggtgagtggaagggttctttactcattctgttcattagggtcttgttgtgttgctttttgctttgccaaattggatgctgttcttgattttcaggagctttgggcaaaatagaagcaaaattgaaagctaattgagtcaattgagatgtttttgagaaatcatttgttggccgttac

SEQ ID NO: 184 - DNA, 200 bp, Amaranthus palmeri
gtaacggccaacaaatgatttctcaaaaacatctcaattgactcaattagctttcaattttgcttctattttgcccaaagctcctgaaaatcaagaacagcatccaatttggcaaagcaaaaagcaacacaacaagaccctaatgaacagaatgagtaaagaacccttccactcacctgctccagcaattacaacttcta

SEQ ID NO: 185 - DNA, 200 bp, Amaranthus palmeri
tgagaaatcatttgttggccgttactgtttattagagaaaaaatatgggtcaagaaacgaaaagataatggaaaaactacttataggtgtcttttttgatcatgaatcatgatggatatatatggtgtcaactatcaagactgccatataactaatgtagtatgcttccttaaggggtggtgaagaatagacgtgtggat

SEQ ID NO: 186 - DNA, 200 bp, Amaranthus palmeri
atccacacgtctattcttcaccaccccttaaggaagcatactacattagttatatggcagtcttgatagttgacaccatatatatccatcatgattcatgatcaaaaaagacacctataagtagtttttccattatcttttcgtttcttgacccatattttttctctaataaacagtaacggccaacaaatgatttctca

SEQ ID NO: 187 - DNA, 200 bp, Amaranthus palmeri
ggtggtgaagaatagacgtgtggatgagaaaattgctgggaatttcctatgcttatgtagaatgagcttcctcttgttgacattagtgaaaagtgaaaaattggtgtatgagtttgcttgatcgcttttgtgagtgcttcattgtccgttccacacctaggttatgttgtagggttgcaatatgttaaattgttagtgac

SEQ ID NO: 188 - DNA, 200 bp, Amaranthus palmeri
gtcactaacaatttaacatattgcaaccctacaacataacctaggtgtggaacggacaatgaagcactcacaaaagcgatcaagcaaactcatacaccaatttttcacttttcactaatgtcaacaagaggaagctcattctacataagcataggaaattcccagcaattttctcatccacacgtctattcttcaccacc

SEQ ID NO: 189 - DNA, 200 bp, Amaranthus palmeri
tgcaatatgttaaattgttagtgacggctgtcgtataacattattgtatcttatgccatgggccaaatttacccctattcaacgacgccatgcagacctaggtgtagtgaaaagtatgcaagggttaattggacatcaagcatggcgccatgttgtttgagtgtggcaaaaagactttacgctacacctctagaccagtt

SEQ ID NO: 190 - DNA, 200 bp, Amaranthus palmeri
aactggtctagaggtgtagcgtaaagtctttttgccacactcaaacaacatggcgccatgcttgatgtccaattaacccttgcatacttttcactacacctaggtctgcatggcgtcgttgaataggggtaaatttggcccatggcataagatacaataatgttatacgacagccgtcactaacaatttaacatattgca

SEQ ID NO: 191 - DNA, 200 bp, Amaranthus palmeri
tttacgctacacctctagaccagttaagtatgtaaagggtgttgggtcaccgctctaaagtggtgtgtcacattttatcgaattcgaggataagctgatcgtggtatcaagtgagaaagaacgcaatatagtggaattagaaagttaagtaataagaaaaaagaaaaaaatgatatctagctttaggaaaatctatcagt

SEQ ID NO: 192 - DNA, 200 bp, Amaranthus palmeri
actgatagattttcctaaagctagatatcatttttttcttttttcttattacttaactttctaattccactatattgcgttctttctcacttgataccacgatcagcttatcctcgaattcgataaaatgtgacacaccactttagagcggtgacccaacaccctttacatacttaactggtctagaggtgtagcgtaaa

SEQ ID NO: 193 - DNA, 200 bp, Amaranthus palmeri
tctagctttaggaaaatctatcagtgaggagaatattgcaaaatatgtggaaattaaaaccaagacaaagctagcgatatatgagacaaagttaaaaatgtacaaagaaatatacgataagttgactcgaaagaagaggataacgatctttataggatagcctaaaggagacaaatgattataaacgatactagttgaat

SEQ ID NO: 194 - DNA, 200 bp, Amaranthus palmeri
attcaactagtatcgtttataatcatttgtctcctttaggctatcctataaagatcgttatcctcttctttcgagtcaacttatcgtatatttctttgtacatttttaactttgtctcatatatcgctagctttgtcttggttttaatttccacatattttgcaatattctcctcactgatagattttcctaaagctaga

SEQ ID NO: 195 - DNA, 200 bp, Amaranthus palmeri
tgattataaacgatactagttgaatgaactatgaagagtgtcttaaccaagcaaatattgtttagaaatagattcagaactttttaattcttcaaatgtgaacgtgagaactgacttctcattctttattttacttcaaggtttggctggtttatccacggcaaagtatttagctgatgcaggtcacaaacccatattgt

SEQ ID NO: 196 - DNA, 200 bp, Amaranthus palmeri
acaatatgggtttgtgacctgcatcagctaaatactttgccgtggataaaccagccaaaccttgaagtaaaataaagaatgagaagtcagttctcacgttcacatttgaagaattaaaaagttctgaatctatttctaaacaatatttgcttggttaagacactcttcatagttcattcaactagtatcgtttataatca

SEQ ID NO: 197 - DNA, 200 bp, Amaranthus palmeri
gatgcaggtcacaaacccatattgttggaagcacgagatgttttaggaggaaaggtgtgtgctatacgtttctcatagcttatgaaataaattcatcgtggttactctcttattagcttatttcagactatcaaataatttttgaactttttcctccctctgttcggctgtattattatatatgtgcagcatgattaaaa

SEQ ID NO: 198 - DNA, 200 bp, Amaranthus palmeri
ttttaatcatgctgcacatatataataatacagccgaacagagggaggaaaaagttcaaaaattatttgatagtctgaaataagctaataagagagtaaccacgatgaatttatttcataagctatgagaaacgtatagcacacacctttcctcctaaaacatctcgtgcttccaacaatatgggtttgtgacctgcatc

SEQ ID NO: 199 - DNA, 200 bp, Amaranthus palmeri
ttatatatgtgcagcatgattaaaactgggttcattaaaatatatgaagttttttttatcaaggcgagattttgtcatccaaaaactttacttctgaacgtgctgtatgatcctgtttctgtatcttcatttgctgggattttcttgaggttcctgactgctttcagttattgtagttacccatcctgcataagtctgag

SEQ ID NO: 200 - DNA, 200 bp, Amaranthus palmeri
ctcagacttatgcaggatgggtaactacaataactgaaagcagtcaggaacctcaagaaaatcccagcaaatgaagatacagaaacaggatcatacagcacgttcagaagtaaagtttttggatgacaaaatctcgccttgataaaaaaaacttcatatattttaatgaacccagttttaatcatgctgcacatatataa

SEQ ID NO: 201 - DNA, 200 bp, Amaranthus palmeri
gttacccatcctgcataagtctgagtttacagttattataatgaaaatgaatcggctaattatatcctcatcacagtatgatgaatcttgggctagtatgaaaatgaggtaggaagaataatttgggttagtttcgtaatatgtgccaagagaaatattgtagtgcaaagtttctttgtatttcttctcgtgcttatatt

SEQ ID NO: 202 - DNA, 200 bp, Amaranthus palmeri
aatataagcacgagaagaaatacaaagaaactttgcactacaatatttctcttggcacatattacgaaactaacccaaattattcttcctacctcattttcatactagcccaagattcatcatactgtgatgaggatataattagccgattcattttcattataataactgtaaactcagacttatgcaggatgggtaac

SEQ ID NO: 203 - DNA, 200 bp, Amaranthus palmeri
ttgtatttcttctcgtgcttatattttttgctccacaggttgcagcgtggaaggatgaggatggtgactggtatgagactgggctacatatattctgtgagtgatcttctaattttctgcttaattggccagttacccatgttcttacaatgcgctctctagtcgtgtttattggaaaatcgatgtactgaacatcttca

SEQ ID NO: 204 - DNA, 200 bp, Amaranthus palmeri
tgaagatgttcagtacatcgattttccaataaacacgactagagagcgcattgtaagaacatgggtaactggccaattaagcagaaaattagaagatcactcacagaatatatgtagcccagtctcataccagtcaccatcctcatccttccacgctgcaacctgtggagcaaaaaatataagcacgagaagaaatacaa

SEQ ID NO: 205 - DNA, 200 bp, Amaranthus palmeri
aaaatcgatgtactgaacatcttcatattttcttgaagttggggcatatccaaatatccaaaatctatttggagaacttggtataaatgaccgactgcaatggaaggagcactctatgatttttgcaatgcctagcaagcccggtgaattcagtcgctttgattttcccgaaatcctgcctgcaccattaaatggttagt

SEQ ID NO: 206 - DNA, 200 bp, Amaranthus palmeri
actaaccatttaatggtgcaggcaggatttcgggaaaatcaaagcgactgaattcaccgggcttgctaggcattgcaaaaatcatagagtgctccttccattgcagtcggtcatttataccaagttctccaaatagattttggatatttggatatgccccaacttcaagaaaatatgaagatgttcagtacatcgatttt

SEQ ID NO: 207 - DNA, 200 bp, Amaranthus palmeri
ctgcctgcaccattaaatggttagtatatcggtgataactgccaaattacttgatgcaatgcagtaccttgttaagtactttggatgtgactccacctataatacttgctataatcttcaatttatttctctttcctacattagaaactataagtatcccgctaaaggacatgaccccacttacaaagttacaatacccc

SEQ ID NO: 208 - DNA, 200 bp, Amaranthus palmeri
ggggtattgtaactttgtaagtggggtcatgtcctttagcgggatacttatagtttctaatgtaggaaagagaaataaattgaagattatagcaagtattataggtggagtcacatccaaagtacttaacaaggtactgcattgcatcaagtaatttggcagttatcaccgatatactaaccatttaatggtgcaggcag

SEQ ID NO: 209 - DNA, 200 bp, Amaranthus palmeri
cccacttacaaagttacaataccccatgaaaatacccactcacccactttttttaatcggtgtaccatccgcccgaggagcaatctcgaggggacagcagagtactactttagtgttattgtgatgaaataggtacctgcatcatatctcatgtcctgtggatacccataaatgaacgaaaaatttcatttttatacata

SEQ ID NO: 210 - DNA, 200 bp, Amaranthus palmeri
tatgtataaaaatgaaatttttcgttcatttatgggtatccacaggacatgagatatgatgcaggtacctatttcatcacaataacactaaagtagtactctgctgtcccctcgagattgctcctcgggcggatggtacaccgattaaaaaaagtgggtgagtgggtattttcatggggtattgtaactttgtaagtggg

SEQ ID NO: 211 - DNA, 200 bp, Amaranthus palmeri
acgaaaaatttcatttttatacatattatcctgctttagaagcttggaatatcattgaacttttttaacgtcccaccatgaaaacaatctgcatcttggtctgtttgcaactcctaaatcctaatgagtcgggctgatttatgtctttgatgcttttgaccgtgtttggcaggcatatgggcaatcctaaggaataatga

SEQ ID NO: 212 - DNA, 200 bp, Amaranthus palmeri
tcattattccttaggattgcccatatgcctgccaaacacggtcaaaagcatcaaagacataaatcagcccgactcattaggatttaggagttgcaaacagaccaagatgcagattgttttcatggtgggacgttaaaaaagttcaatgatattccaagcttctaaagcaggataatatgtataaaaatgaaatttttcgt

SEQ ID NO: 213 - DNA, 200 bp, Amaranthus palmeri
tatgggcaatcctaaggaataatgaaatgctaacctggccagaaaaaatcaagtttgccattggcttgttgcctgctatggcaggcggacagtcatatgttgaagcacaagatggtttgagtgtccaagagtggatgagaaaacaagtaggagcagactttcgtttcagattttcctcattttgttaatggttctagctg

SEQ ID NO: 214 - DNA, 200 bp, Amaranthus palmeri
cagctagaaccattaacaaaatgaggaaaatctgaaacgaaagtctgctcctacttgttttctcatccactcttggacactcaaaccatcttgtgcttcaacatatgactgtccgcctgccatagcaggcaacaagccaatggcaaacttgattttttctggccaggttagcatttcattattccttaggattgcccata

SEQ ID NO: 215 - DNA, 200 bp, Amaranthus palmeri
ctcattttgttaatggttctagctgtaaactttgactttgttgggacgtcaatgctgaaattttgtttgtgcattaatgcagggagtacccgatcgtgtaactgatgatgtgtttattgccatgtcaaaggcactgaacttcataaatcccgatgaactttcaatgcagtgcatcttgattgctctgaaccgattcctgc

SEQ ID NO: 216 - DNA, 200 bp, Amaranthus palmeri
gcaggaatcggttcagagcaatcaagatgcactgcattgaaagttcatcgggatttatgaagttcagtgcctttgacatggcaataaacacatcatcagttacacgatcgggtactccctgcattaatgcacaaacaaaatttcagcattgacgtcccaacaaagtcaaagtttacagctagaaccattaacaaaatgag

SEQ ID NO: 217 - DNA, 200 bp, Amaranthus palmeri
ttgattgctctgaaccgattcctgcaggcatgactgctttttaatttccgctttaaatttttggttttgtacaatacttcttagtgcttgtttttgtgacttttctcgagtaaataggggatgtaaaatgaccgtgctgtttttcatgaactgacgttgggtaatgtatatcaacaggagaaacatggttctaagatggc

SEQ ID NO: 218 - DNA, 200 bp, Amaranthus palmeri
gccatcttagaaccatgtttctcctgttgatatacattacccaacgtcagttcatgaaaaacagcacggtcattttacatcccctatttactcgagaaaagtcacaaaaacaagcactaagaagtattgtacaaaaccaaaaatttaaagcggaaattaaaaagcagtcatgcctgcaggaatcggttcagagcaatcaa

SEQ ID NO: 219 - DNA, 200 bp, Amaranthus palmeri
aggagaaacatggttctaagatggccttcctagacggaaaccctccagagaggctgtgcatgcctattgttaagcacatcgagtcactaggtggtgaagttaaactaaattctcgtatacaaaagattcagttggaccagagtggaagcgtgaagagttttttgctaaataacgggagggaaatacgaggagatgcctat

SEQ ID NO: 220 - DNA, 200 bp, Amaranthus palmeri
ataggcatctcctcgtatttccctcccgttatttagcaaaaaactcttcacgcttccactctggtccaactgaatcttttgtatacgagaatttagtttaacttcaccacctagtgactcgatgtgcttaacaataggcatgcacagcctctctggagggtttccgtctaggaaggccatcttagaaccatgtttctcct

SEQ ID NO: 221 - DNA, 200 bp, Amaranthus palmeri
gagggaaatacgaggagatgcctatgtttttgccaccccaggttttcttctctccctttttttaccattagttttctattagactcagtaaaagctagagtaaagaaaatgaagattctattacagaaatggacacactgtaaagcttaattagttttgatcttgggcaaagcatttgtgtttccaaatttgttaatggt

SEQ ID NO: 222 - DNA, 200 bp, Amaranthus palmeri
accattaacaaatttggaaacacaaatgctttgcccaagatcaaaactaattaagctttacagtgtgtccatttctgtaatagaatcttcattttctttactctagcttttactgagtctaatagaaaactaatggtaaaaaaagggagagaagaaaacctggggtggcaaaaacataggcatctcctcgtatttccctc

SEQ ID NO: 223 - DNA, 200 bp, Amaranthus palmeri
ttgtgtttccaaatttgttaatggttattatttaaatagaacacttatgtttgtgatgggtaacaataggtcaagcgttgagccaaagtgttataacaatgattatatagtgtatatcatagtgtaaaattgcggtaacggacgcaatcacagtgtcgggagtgattcggtatcataacgcctaaatatcggtcgaaacc

SEQ ID NO: 224 - DNA, 200 bp, Amaranthus palmeri
ggtttcgaccgatatttaggcgttatgataccgaatcactcccgacactgtgattgcgtccgttaccgcaattttacactatgatatacactatataatcattgttataacactttggctcaacgcttgacctattgttacccatcacaaacataagtgttctatttaaataataaccattaacaaatttggaaacacaa

SEQ ID NO: 225 - DNA, 200 bp, Amaranthus palmeri
taacgcctaaatatcggtcgaaaccataagctttgaaacggcccaaaacacggttttttttaaaaactttacgacgcgagaaatatcgttttgtttattttgaaaacctttacgaagcgacgatgcgatgcagccttgttttaactctatagtgtacataggaatatacaattaagcaaatagtcgtaagtgatatctca

SEQ ID NO: 226 - DNA, 200 bp, Amaranthus palmeri
tgagatatcacttacgactatttgcttaattgtatattcctatgtacactatagagttaaaacaaggctgcatcgcatcgtcgcttcgtaaaggttttcaaaataaacaaaacgatatttctcgcgtcgtaaagtttttaaaaaaaaccgtgttttgggccgtttcaaagcttatggtttcgaccgatatttaggcgtta

SEQ ID NO: 227 - DNA, 200 bp, Amaranthus palmeri
gcaaatagtcgtaagtgatatctcaaaagggacaagtgtgaaataggctaaagagttgaattaattgtgggattgacaattgtttcatcactggtcctctattgctttccttggtaaaatgttgcatacttgtttattgatttacactacatataattagttctgtagaatatgttcttgagtcaaagcatgggtcgatg

SEQ ID NO: 228 - DNA, 200 bp, Amaranthus palmeri
catcgacccatgctttgactcaagaacatattctacagaactaattatatgtagtgtaaatcaataaacaagtatgcaacattttaccaaggaaagcaatagaggaccagtgatgaaacaattgtcaatcccacaattaattcaactctttagcctatttcacacttgtcccttttgagatatcacttacgactatttgc

SEQ ID NO: 229 - DNA, 200 bp, Amaranthus palmeri
tcttgagtcaaagcatgggtcgatgtttgaggttgatgttggatttgcttgggcaagcaattacgaatatcttggtttaaggaacccatgaaaatggagcagcttgcaacgaaaacaaagcccagttgaaagcctgctcgggtgagcagcatcgcgttggggccagcatgatgagctgttcaaacacagaagttactgga

SEQ ID NO: 230 - DNA, 200 bp, Amaranthus palmeri
tccagtaacttctgtgtttgaacagctcatcatgctggccccaacgcgatgctgctcacccgagcaggctttcaactgggctttgttttcgttgcaagctgctccattttcatgggttccttaaaccaagatattcgtaattgcttgcccaagcaaatccaacatcaacctcaaacatcgacccatgctttgactcaaga

SEQ ID NO: 231 - DNA, 200 bp, Amaranthus palmeri
ctgttcaaacacagaagttactggagtgctagtgctctggcaagcaagcacagcgcagcttacttttctttaatttttgattctatctagaattctaactaaaccctaatgcttacgattgattagtataattaaaacccataaagtgaatgagttgttcaaatacttgacaattgacattatttgagtggtcgtggatg

SEQ ID NO: 232 - DNA, 200 bp, Amaranthus palmeri
catccacgaccactcaaataatgtcaattgtcaagtatttgaacaactcattcactttatgggttttaattatactaatcaatcgtaagcattagggtttagttagaattctagatagaatcaaaaattaaagaaaagtaagctgcgctgtgcttgcttgccagagcactagcactccagtaacttctgtgtttgaacag

SEQ ID NO: 233 - DNA, 200 bp, Amaranthus palmeri
gacattatttgagtggtcgtggatgtagtgttgtaacaaaattgtcacttatgagttaggaccatatccttgcgaaggtggagatacacttggtagaatacggtgaaaagtatcacctttccatagatagtatagcgttataagtgaatttattatattgtgctgtcatatcagtgtaacataatttgtagctaatccgc

SEQ ID NO: 234 - DNA, 200 bp, Amaranthus palmeri
gcggattagctacaaattatgttacactgatatgacagcacaatataataaattcacttataacgctatactatctatggaaaggtgatacttttcaccgtattctaccaagtgtatctccaccttcgcaaggatatggtcctaactcataagtgacaattttgttacaacactacatccacgaccactcaaataatgtc

SEQ ID NO: 235 - DNA, 200 bp, Amaranthus palmeri
gtaacataatttgtagctaatccgctttttgaatacggaattcgctcgaaattgttgaaaaataacccaagaccgaccatattttgcttttttcggtttgcgattcgcagggagattagagaaccatgtaacattgtattttgatataatttttgaatttcattgtcagttgacatcttgaagctgttactacccgatac

SEQ ID NO: 236 - DNA, 200 bp, Amaranthus palmeri
gtatcgggtagtaacagcttcaagatgtcaactgacaatgaaattcaaaaattatatcaaaatacaatgttacatggttctctaatctccctgcgaatcgcaaaccgaaaaaagcaaaatatggtcggtcttgggttatttttcaacaatttcgagcgaattccgtattcaaaaagcggattagctacaaattatgttac

SEQ ID NO: 237 - DNA, 200 bp, Amaranthus palmeri
tcttgaagctgttactacccgatacttggaaggaaatctcatacttcaaaaagcttgagaaattagtgggcgttcctgtgattaatgttcacatatggttagttaattcttcattctatattaaatttacttgttaggttttatacctaatcaactgcttttagttttgacattttgtccgacaataagtggacgtttct

SEQ ID NO: 238 - DNA, 200 bp, Amaranthus palmeri
agaaacgtccacttattgtcggacaaaatgtcaaaactaaaagcagttgattaggtataaaacctaacaagtaaatttaatatagaatgaagaattaactaaccatatgtgaacattaatcacaggaacgcccactaatttctcaagctttttgaagtatgagatttccttccaagtatcgggtagtaacagcttcaaga

SEQ ID NO: 239 - DNA, 200 bp, Amaranthus palmeri
tgtccgacaataagtggacgtttctgttttgttgcgttttgtgaatttcttttgattacaggggctaattatataataatgcttcatgcaggtttgacagaaaattaaagaatacatatgaccatctactcttcagcaggttgtatttcgtttctttaatcatcctatttctctttcgtaactcttaaataatctcgttc

SEQ ID NO: 240 - DNA, 200 bp, Amaranthus palmeri
gaacgagattatttaagagttacgaaagagaaataggatgattaaagaaacgaaatacaacctgctgaagagtagatggtcatatgtattctttaattttctgtcaaacctgcatgaagcattattatataattagcccctgtaatcaaaagaaattcacaaaacgcaacaaaacagaaacgtccacttattgtcggaca

SEQ ID NO: 241 - DNA, 200 bp, Amaranthus palmeri
tcgtaactcttaaataatctcgttcttccccttccctccttcacttcaacttgtttcaactcttcattttcggtcgtagtcaaatttgatgagtatttgacaagagttgcatcataagtaatatgaacattggaggagtgacaatcatcatttatgaagtattaactaagattcctttaagaaggtgaaagttttaagtg

SEQ ID NO: 242 - DNA, 200 bp, Amaranthus palmeri
cacttaaaactttcaccttcttaaaggaatcttagttaatacttcataaatgatgattgtcactcctccaatgttcatattacttatgatgcaactcttgtcaaatactcatcaaatttgactacgaccgaaaatgaagagttgaaacaagttgaagtgaaggagggaaggggaagaacgagattatttaagagttacga

SEQ ID NO: 243 - DNA, 200 bp, Amaranthus palmeri
tttaagaaggtgaaagttttaagtgaaaattttctttccattgggaaataagtcttttgattaatgtcttgaatagatgaaggatgcgagtttttggaatgaagagaaacgttttatgtgatctagttgcgagtcgatagtgccctgaatttcttcaaaattgagcatttttgttatcgttcgctttatttttgcacttt

SEQ ID NO: 244 - DNA, 200 bp, Amaranthus palmeri
aaagtgcaaaaataaagcgaacgataacaaaaatgctcaattttgaagaaattcagggcactatcgactcgcaactagatcacataaaacgtttctcttcattccaaaaactcgcatccttcatctattcaagacattaatcaaaagacttatttcccaatggaaagaaaattttcacttaaaactttcaccttcttaaa

SEQ ID NO: 245 - DNA, 200 bp, Amaranthus palmeri
atcgttcgctttatttttgcactttcatgtccttttcttaaagttgtatatgacttttcattctcaacttaggcttacctcgatgcttaaagtgtctcctttacttttgcccaaattttaggaacgtgtaagttacaggatacaaattaaagttagggaatcgtgtagggctcgtaaaaaatgacaatcaccaataactt

SEQ ID NO: 246 - DNA, 200 bp, Amaranthus palmeri
aagttattggtgattgtcattttttacgagccctacacgattccctaactttaatttgtatcctgtaacttacacgttcctaaaatttgggcaaaagtaaaggagacactttaagcatcgaggtaagcctaagttgagaatgaaaagtcatatacaactttaagaaaaggacatgaaagtgcaaaaataaagcgaacgat

SEQ ID NO: 247 - DNA, 200 bp, Amaranthus palmeri
aaaaaatgacaatcaccaataactttctaaatatcaaaatgggtcacttgtggtgaactgatccatatgaaaattagacacttgtgctgagatggagcaagtattataacttatgaaaacataatacttggggtggatgtacctttgttaggaaccatagtgccaaaatgcaataacgccataacggtaacgacacgatg

SEQ ID NO: 248 - DNA, 200 bp, Amaranthus palmeri
catcgtgtcgttaccgttatggcgttattgcattttggcactatggttcctaacaaaggtacatccaccccaagtattatgttttcataagttataatacttgctccatctcagcacaagtgtctaattttcatatggatcagttcaccacaagtgacccattttgatatttagaaagttattggtgattgtcatttttt

SEQ ID NO: 249 - DNA, 200 bp, Amaranthus palmeri
acgccataacggtaacgacacgatgatgcgtttatcataactccaaatatcggctaaaagcatgagatattccttgtaccggcccaaaacagggtttttttacacctttacattatgagaaatatcgtttttttttttttttgaaaatctttagaacacgaccgatgcagcgcgatgcgaccttatttttgcactatggt

SEQ ID NO: 250 - DNA, 200 bp, Amaranthus palmeri
accatagtgcaaaaataaggtcgcatcgcgctgcatcggtcgtgttctaaagattttcaaaaaaaaaaaaaaacgatatttctcataatgtaaaggtgtaaaaaaaccctgttttgggccggtacaaggaatatctcatgcttttagccgatatttggagttatgataaacgcatcatcgtgtcgttaccgttatggcgt

SEQ ID NO: 251 - DNA, 200 bp, Amaranthus palmeri
tgcgaccttatttttgcactatggtagggacagcatttgcggatgcacacattggttaccatttctgacccccttttcacttttacagatcctatggatataagtatgttactgattctaaaacttcattccctaggattaaatgtagaaaccatataaggatggatctttaagatacttttatctatatcctttcctga

SEQ ID NO: 252 - DNA, 200 bp, Amaranthus palmeri
tcaggaaaggatatagataaaagtatcttaaagatccatccttatatggtttctacatttaatcctagggaatgaagttttagaatcagtaacatacttatatccataggatctgtaaaagtgaaaagggggtcagaaatggtaaccaatgtgtgcatccgcaaatgctgtccctaccatagtgcaaaaataaggtcgca

SEQ ID NO: 253 - DNA, 200 bp, Amaranthus palmeri
tacttttatctatatcctttcctgaaccctattaaatatctatggcctacaagaggtggtcacaattcatcatcctcttcgtccacttcatgcattttaaacatatcttcgagttctcctttaattgtttatctttgttattccaggagtcctcttttgagtgtctatgctgatatgtcggagacatgcaaggtgagcat

SEQ ID NO: 254 - DNA, 200 bp, Amaranthus palmeri
atgctcaccttgcatgtctccgacatatcagcatagacactcaaaagaggactcctggaataacaaagataaacaattaaaggagaactcgaagatatgtttaaaatgcatgaagtggacgaagaggatgatgaattgtgaccacctcttgtaggccatagatatttaatagggttcaggaaaggatatagataaaagta

SEQ ID NO: 255 - DNA, 200 bp, Amaranthus palmeri
tgtcggagacatgcaaggtgagcatattcccatttgtcgctcttttgatttctgacttgtatgttctggttctccatttgtcgctctttcgcgcgtataatttcgaatgttagccactccccgtcactcctcccattctgcaatcaccgggattttaactatgagggtccttagaatcgattataaaaattcgacaaaaa

SEQ ID NO: 256 - DNA, 200 bp, Amaranthus palmeri
tttttgtcgaatttttataatcgattctaaggaccctcatagttaaaatcccggtgattgcagaatgggaggagtgacggggagtggctaacattcgaaattatacgcgcgaaagagcgacaaatggagaaccagaacatacaagtcagaaatcaaaagagcgacaaatgggaatatgctcaccttgcatgtctccgaca

SEQ ID NO: 257 - DNA, 200 bp, Amaranthus palmeri
atcgattataaaaattcgacaaaaacaaaaaaaaaagacataaaattgacgggccataacaattttacataagatattcaacattttttttgcgaattttcttaataaattccgtaattccgtacatctatactcccgagccccttcatgtgtgcgctgcggctttaagaaacctttcttataagtgttgactgtatgag

SEQ ID NO: 258 - DNA, 200 bp, Amaranthus palmeri
ctcatacagtcaacacttataagaaaggtttcttaaagccgcagcgcacacatgaaggggctcgggagtatagatgtacggaattacggaatttattaagaaaattcgcaaaaaaaatgttgaatatcttatgtaaaattgttatggcccgtcaattttatgtcttttttttttgtttttgtcgaatttttataatcgat

SEQ ID NO: 259 - DNA, 200 bp, Amaranthus palmeri
ttcttataagtgttgactgtatgagctgacaggctgtcttttccgtcccaataatcatttacaggaatataaggatccaaatagatccatgctggaactggtttttgcacccgcggaggaatggatttctcgaagcgacactgatattattgaggcaacaatgaaagagcttgccaagcttttcccggatgaaattgctg

SEQ ID NO: 260 - DNA, 200 bp, Amaranthus palmeri
cagcaatttcatccgggaaaagcttggcaagctctttcattgttgcctcaataatatcagtgtcgcttcgagaaatccattcctccgcgggtgcaaaaaccagttccagcatggatctatttggatccttatattcctgtaaatgattattgggacggaaaagacagcctgtcagctcatacagtcaacacttataagaa

SEQ ID NO: 261 - DNA, 200 bp, Amaranthus palmeri
aagcttttcccggatgaaattgctgccgatgggagcaaggccaagatcctcaaatatcatgtcgtcaaaactccaaggtgatcgataagcttgtgtaattaaaattggataattttatgctaccgctagaaacagcattaatgttgtgcccgcgggctcttttataggtcggtttataagactgtaccggattgtgaacc

SEQ ID NO: 262 - DNA, 200 bp, Amaranthus palmeri
ggttcacaatccggtacagtcttataaaccgacctataaaagagcccgcgggcacaacattaatgctgtttctagcggtagcataaaattatccaattttaattacacaagcttatcgatcaccttggagttttgacgacatgatatttgaggatcttggccttgctcccatcggcagcaatttcatccgggaaaagctt

SEQ ID NO: 263 - DNA, 200 bp, Amaranthus palmeri
ataagactgtaccggattgtgaaccttgtcggccgctgcaaagatcaccaatagagggtttctatttagctggtgattacacaaaacaaaaatatttggcttctatggaaggtgctgtcttatctgggaagctttgtgcacaggctatcgtacaggtaatcaaattttgatggaacaccgcgtgcatgctgattagactt

SEQ ID NO: 264 - DNA, 200 bp, Amaranthus palmeri
aagtctaatcagcatgcacgcggtgttccatcaaaatttgattacctgtacgatagcctgtgcacaaagcttcccagataagacagcaccttccatagaagccaaatatttttgttttgtgtaatcaccagctaaatagaaaccctctattggtgatctttgcagcggccgacaaggttcacaatccggtacagtcttat

SEQ ID NO: 265 - DNA, 200 bp, Amaranthus palmeri
caccgcgtgcatgctgattagacttttcgtattttgatttgatttgaaattgacccaaaaccgaccggaaattagtgggttacttataactcagaaaatatgacccgtaacctgaaaatgactcaaacccaccgtagcccaaatccaaccgttttgacttgtttacctaattttgtcaacttttcttgttccaagtcatt

SEQ ID NO: 266 - DNA, 200 bp, Amaranthus palmeri
aatgacttggaacaagaaaagttgacaaaattaggtaaacaagtcaaaacggttggatttgggctacggtgggtttgagtcattttcaggttacgggtcatattttctgagttataagtaacccactaatttccggtcggttttgggtcaatttcaaatcaaatcaaaatacgaaaagtctaatcagcatgcacgcggtg

SEQ ID NO: 267 - DNA, 200 bp, Amaranthus palmeri
tcaacttttcttgttccaagtcattagttttctgtcggaacccactttctttcgagtctttttttgtatttcttttatcttcgttgatgcttttattcgtttatacctagttatgttgatatatttatatgtatatatttatttatatgctttttactactgaggtatgatgttctagagtatgatgatgatgatttatt

SEQ ID NO: 268 - DNA, 200 bp, Amaranthus palmeri
aataaatcatcatcatcatactctagaacatcatacctcagtagtaaaaagcatataaataaatatatacatataaatatatcaacataactaggtataaacgaataaaagcatcaacgaagataaaagaaatacaaaaaaagactcgaaagaaagtgggttccgacagaaaactaatgacttggaacaagaaaagttga

SEQ ID NO: 269 - DNA, 200 bp, Amaranthus palmeri
tagagtatgatgatgatgatttattctttttatattaaaaaaaaagtttaggtctttttgaaaacattttagtgattttttctaaacttgtgacccgatcgaaatttgatccgaaccaaaaataacccgatcaaaagtgactcaacccgaaacctaccctgatctaattgtaatgatagctttgaaatttttatcgttct

SEQ ID NO: 270 - DNA, 200 bp, Amaranthus palmeri
agaacgataaaaatttcaaagctatcattacaattagatcagggtaggtttcgggttgagtcacttttgatcgggttatttttggttcggatcaaatttcgatcgggtcacaagtttagaaaaaatcactaaaatgttttcaaaaagacctaaactttttttttaatataaaaagaataaatcatcatcatcatactcta

SEQ ID NO: 271 - DNA, 200 bp, Amaranthus palmeri
atagctttgaaatttttatcgttctagttaacaagttctgttgaagttaatataaatctcgaacgttcctataaacttattttttagattgtcaaggttagttagttgtatagaagttaagtagcttaaacaactagtccatattttgtatatgtgtaggattatgatctgctgagttctcgagcacaaagagaattggc

SEQ ID NO: 272 - DNA, 200 bp, Amaranthus palmeri
gccaattctctttgtgctcgagaactcagcagatcataatcctacacatatacaaaatatggactagttgtttaagctacttaacttctatacaactaactaaccttgacaatctaaaaaataagtttataggaacgttcgagatttatattaacttcaacagaacttgttaactagaacgataaaaatttcaaagctat

SEQ ID NO: 273 - DNA, 200 bp, Amaranthus palmeri
gttctcgagcacaaagagaattggcggcgacaagcaatgtataaccctaaattgcttcgacatccgccatctattttcattcgagatttggattgggaatctgatcatcgaataacgatcagctgcaaacaaaattatgagggttgcatactggtgctgttcaagttcttgatgtataaattctccagaaagaagattta

SEQ ID NO: 274 - DNA, 200 bp, Amaranthus palmeri
taaatcttctttctggagaatttatacatcaagaacttgaacagcaccagtatgcaaccctcataattttgtttgcagctgatcgttattcgatgatcagattcccaatccaaatctcgaatgaaaatagatggcggatgtcgaagcaatttagggttatacattgcttgtcgccgccaattctctttgtgctcgagaac

SEQ ID NO: 275 - DNA, 200 bp, Amaranthus palmeri
ataaattctccagaaagaagatttatttgtaatgatatatcaattgatagaaatatgtatagcttacttctaaggaattatgtatgtgcaccatttgtaacttgattgaaatgtaagtatcaacttggtctcttgattgaaatgtaagtatcaacataatacaaatttataccaatacatttatttcccttttttgttta

SEQ ID NO: 276 - DNA, 200 bp, Amaranthus palmeri
taaacaaaaaagggaaataaatgtattggtataaatttgtattatgttgatacttacatttcaatcaagagaccaagttgatacttacatttcaatcaagttacaaatggtgcacatacataattccttagaagtaagctatacatatttctatcaattgatatatcattacaaataaatcttctttctggagaatttat

SEQ ID NO: 277 - DNA, 200 bp, Amaranthus palmeri
tacatttatttcccttttttgtttaattatgtgttttttgttgttttttatttgtaactagagtcactcatactccaacggtctgtctggtttgtggtattaaacggtggtgatgagaataaaaactagtgtaattttgattaaaaattctcttgctattttgatggccatggttgtgtttgatgagaaggaatatgaaa

SEQ ID NO: 278 - DNA, 200 bp, Amaranthus palmeri
tttcatattccttctcatcaaacacaaccatggccatcaaaatagcaagagaatttttaatcaaaattacactagtttttattctcatcaccaccgtttaataccacaaaccagacagaccgttggagtatgagtgactctagttacaaataaaaaacaacaaaaaacacataattaaacaaaaaagggaaataaatgta

SEQ ID NO: 279 - DNA, 200 bp, Amaranthus palmeri
gtgtttgatgagaaggaatatgaaaactagtgtaggtggtattaaacagtgccacggtggtaatgagaatgaaaactagtgtaatttgggttaaaaaaatctcttgtctttaatcatctcattttctttataaatttcaatccaatgcattactatcgggagagatggtatcaggtggtaatggaaatttgtaaataaaa

SEQ ID NO: 280 - DNA, 200 bp, Amaranthus palmeri
ttttatttacaaatttccattaccacctgataccatctctcccgatagtaatgcattggattgaaatttataaagaaaatgagatgattaaagacaagagatttttttaacccaaattacactagttttcattctcattaccaccgtggcactgtttaataccacctacactagttttcatattccttctcatcaaacac

SEQ ID NO: 281 - DNA, 200 bp, Amaranthus palmeri
ccctcttatcaatctatatccaaaactatttcattttccaaacttttttaaacccaaaaatcaaaacttttgattgaagaacaaactttgggggttttggaaaatgagtcattttggatatgcttgtgctactcaatccacatcaagatatgttcttttaggaaattcaaataaccccacttcaatttcatctattggaa

SEQ ID NO: 282 - DNA, 200 bp, Amaranthus palmeri
ttccaatagatgaaattgaagtggggttatttgaatttcctaaaagaacatatcttgatgtggattgagtagcacaagcatatccaaaatgactcattttccaaaacccccaaagtttgttcttcaatcaaaagttttgatttttgggtttaaaaaagtttggaaaatgaaatagttttggatatagattgataagaggg

SEQ ID NO: 283 - DNA, 200 bp, Amaranthus palmeri
cccacttcaatttcatctattggaagtgattttttgggtcattctgtgagaaatttcagtgttagtaaagtttatggggaaagcaaagaaatgggcattgccctttaaaggttgtttgtatagattatcctaggccagagcttgaaagtacatccaatttcttggaagccgcctacttatcttctacttttcggaattcg

SEQ ID NO: 284 - DNA, 200 bp, Amaranthus palmeri
cgaattccgaaaagtagaagataagtaggcggcttccaagaaattggatgtactttcaagctctggcctaggataatctatacaaacaacctttaaagggcaatgcccatttctttgctttccccataaactttactaacactgaaatttctcacagaatgacccaaaaaatcacttccaatagatgaaattgaagtggg

SEQ ID NO: 285 - DNA, 200 bp, Amaranthus palmeri
cttatcttctacttttcggaattcgcctcgtcctcagaagccattagaagttgtaattgctggagcaggtttggctggtttatccacggcaaagtatttagctgatgcaggtcacaaacccatattgttggaagcacgagatgttttaggaggaaaggttgcagcgtggaaggatgaggatggtgactggtatgagactg

SEQ ID NO: 286 - DNA, 200 bp, Amaranthus palmeri
cagtctcataccagtcaccatcctcatccttccacgctgcaacctttcctcctaaaacatctcgtgcttccaacaatatgggtttgtgacctgcatcagctaaatactttgccgtggataaaccagccaaacctgctccagcaattacaacttctaatggcttctgaggacgaggcgaattccgaaaagtagaagataag

SEQ ID NO: 287 - DNA, 200 bp, Amaranthus palmeri
gaggatggtgactggtatgagactgggctacatatattctttggggcatatccaaatgtccaaaatctatttggagaacttggtataaatgaccgactgcaatggaaggagcactctatgatttttgcaatgccagcaagcccggtgaattcagtcgctttgattttcccgaaatcctgcctgcaccattaaatggcata

SEQ ID NO: 288 - DNA, 200 bp, Amaranthus palmeri
tatgccatttaatggtgcaggcaggatttcgggaaaatcaaagcgactgaattcaccgggcttgctggcattgcaaaaatcatagagtgctccttccattgcagtcggtcatttataccaagttctccaaatagattttggacatttggatatgccccaaagaatatatgtagcccagtctcataccagtcaccatcctc

SEQ ID NO: 289 - DNA, 200 bp, Amaranthus palmeri
cctgcctgcaccattaaatggcatatgggcaatcctaaggaataatgaaatgctaacctggccagaaaaaatcaagtttgccattggcttgttgcctgctatggcgggcggacagtcatatgttgaagcacaagatggtttgagtgtccaagagtggatgagaaaacaaggagtacccgatcgtgtaactgatgaagtgt

SEQ ID NO: 290 - DNA, 200 bp, Amaranthus palmeri
acacttcatcagttacacgatcgggtactccttgttttctcatccactcttggacactcaaaccatcttgtgcttcaacatatgactgtccgcccgccatagcaggcaacaagccaatggcaaacttgattttttctggccaggttagcatttcattattccttaggattgcccatatgccatttaatggtgcaggcagg

SEQ ID NO: 291 - DNA, 200 bp, Amaranthus palmeri
cccgatcgtgtaactgatgaagtgtttattgccatgtcaaaggcactgaacttcataaatcccgatgaactttcaatgcagtgcatcttgattgctctgaaccgattcctgcaggagaaacatggttctaagatggccttcctagacggaaaccctccagagaggctgtgcatgcctattgttaagcacatcgagtcact

SEQ ID NO: 292 - DNA, 200 bp, Amaranthus palmeri
agtgactcgatgtgcttaacaataggcatgcacagcctctctggagggtttccgtctaggaaggccatcttagaaccatgtttctcctgcaggaatcggttcagagcaatcaagatgcactgcattgaaagttcatcgggatttatgaagttcagtgcctttgacatggcaataaacacttcatcagttacacgatcggg

SEQ ID NO: 293 - DNA, 200 bp, Amaranthus palmeri
ctattgttaagcacatcgagtcactaggtggtgaagttaaacttaactctcgtatacaaaagattcagttggaccagagtggaagcgtgaagagttttttgctaaataacgggagggaaatacgaggagatgcctatgtttttgccaccccagttgacatcttgaagctgttactacccgatacttggaaggaaatctca

SEQ ID NO: 294 - DNA, 200 bp, Amaranthus palmeri
tgagatttccttccaagtatcgggtagtaacagcttcaagatgtcaactggggtggcaaaaacataggcatctcctcgtatttccctcccgttatttagcaaaaaactcttcacgcttccactctggtccaactgaatcttttgtatacgagagttaagtttaacttcaccacctagtgactcgatgtgcttaacaatag

SEQ ID NO: 295 - DNA, 200 bp, Amaranthus palmeri
acccgatacttggaaggaaatctcatacttcaaaaagcttgagaaattagtgggcgttcctgtgattaatgttcacatatggtttgacagaaaattaaagaatacatatgaccatctactcttcagcaggagtcctcttttgagtgtctatgctgatatgtcggagacatgcaaggaatataaggatccaaatagatcca

SEQ ID NO: 296 - DNA, 200 bp, Amaranthus palmeri
tggatctatttggatccttatattccttgcatgtctccgacatatcagcatagacactcaaaagaggactcctgctgaagagtagatggtcatatgtattctttaattttctgtcaaaccatatgtgaacattaatcacaggaacgcccactaatttctcaagctttttgaagtatgagatttccttccaagtatcgggt

SEQ ID NO: 297 - DNA, 200 bp, Amaranthus palmeri
gaatataaggatccaaatagatccatgctggaactggtttttgcacccgcggaggaatggatttcacgaagcgacactgatattatgaggcaacaatgaaagagcttgccaagcttttcccggatgaaatcgctgccgatggaagcaaggccaagatcctcaaatatcatgtcgtcaaaactccaaggtcggtttataag

SEQ ID NO: 298 - DNA, 200 bp, Amaranthus palmeri
cttataaaccgaccttggagttttgacgacatgatatttgaggatcttggccttgcttccatcggcagcgatttcatccgggaaaagcttggcaagctctttcattgttgcctcataatatcagtgtcgcttcgtgaaatccattcctccgcgggtgcaaaaaccagttccagcatggatctatttggatccttatattc

SEQ ID NO: 299 - DNA, 200 bp, Amaranthus palmeri
caaaactccaaggtcggtttataagactgtaccggattgtgaaccttgtcggccgctgcaaagatcaccaatagagggtttctatttagctggtgattacacaaaacaaaaatatttggcttctatggaaggtgctgtcttatctgggaagctttgtgcacaggctatcgtacaggattatgatctgctgagttctcgag

SEQ ID NO: 300 - DNA, 200 bp, Amaranthus palmeri
ctcgagaactcagcagatcataatcctgtacgatagcctgtgcacaaagcttcccagataagacagcaccttccatagaagccaaatatttttgttttgtgtaatcaccagctaaatagaaaccctctattggtgatctttgcagcggccgacaaggttcacaatccggtacagtcttataaaccgaccttggagttttg

SEQ ID NO: 301 - DNA, 200 bp, Amaranthus palmeri
gattatgatctgctgagttctcgagcacaaagagaattggcggcgacaagcaatgtataaccctaaattgcttcgacatccgccatcgattttcattcgagatttggattgggaatctaatcatcgaataatgattagatgtaaacaaaattatgggggttgcatactggtgttcttcaagttcttgatgtataaattct

SEQ ID NO: 302 - DNA, 200 bp, Amaranthus palmeri
agaatttatacatcaagaacttgaagaacaccagtatgcaacccccataattttgtttacatctaatcattattcgatgattagattcccaatccaaatctcgaatgaaaatcgatggcggatgtcgaagcaatttagggttatacattgcttgtcgccgccaattctctttgtgctcgagaactcagcagatcataatc

SEQ ID NO: 303 - DNA, 200 bp, Amaranthus palmeri
ctaattatataataatgcttcatgcaggtttgacagaaaattaaagaatacatatgaccatctactcttcagcaggttgtattttgtttctttaatcatcctatttctctttcgtaacttaaataatctcgttcttccccttccctccttcacttcaacacttgtttcaattcttcattttcggtcgtagtaaaaattga

SEQ ID NO: 304 - DNA, 200 bp, Amaranthus palmeri
tcaatttttactacgaccgaaaatgaagaattgaaacaagtgttgaagtgaaggagggaaggggaagaacgagattatttaagttacgaaagagaaataggatgattaaagaaacaaaatacaacctgctgaagagtagatggtcatatgtattctttaattttctgtcaaacctgcatgaagcattattatataattag

SEQ ID NO: 305 - DNA, 200 bp, Amaranthus palmeri
cattttcggtcgtagtaaaaattgatgtatatttgacaagagttgcatcataagtaatatgaacattggaggagtgacaatcatcatttatgaagtataaactaagattcctttaagaaggtgaaagtttaagtgaaaattttctttccattgggaaatagtcttttgattaacatcttgaatagatgaaggatgcgagt

SEQ ID NO: 306 - DNA, 200 bp, Amaranthus palmeri
actcgcatccttcatctattcaagatgttaatcaaaagactatttcccaatggaaagaaaattttcacttaaactttcaccttcttaaaggaatcttagtttatacttcataaatgatgattgtcactcctccaatgttcatattacttatgatgcaactcttgtcaaatatacatcaatttttactacgaccgaaaatg

SEQ ID NO: 307 - DNA, 200 bp, Amaranthus palmeri
tcttgaatagatgaaggatgcgagtttttggaatgaagagaaatattttatgtgatctagttgagagtcgatggtgccttgaatttcttcaaaattgagcattttgtgaacgttcgctttatttttgcactttcatgtccttttcttaaaagtagtatatggcttttcattctcaacttaggcttacctcaatgcctaaa

SEQ ID NO: 308 - DNA, 200 bp, Amaranthus palmeri
tttaggcattgaggtaagcctaagttgagaatgaaaagccatatactacttttaagaaaaggacatgaaagtgcaaaaataaagcgaacgttcacaaaatgctcaattttgaagaaattcaaggcaccatcgactctcaactagatcacataaaatatttctcttcattccaaaaactcgcatccttcatctattcaaga

SEQ ID NO: 309 - DNA, 200 bp, Amaranthus palmeri
gatatactgggtatgaagatgatttattcttttttaataaaaaagtttaggtcttttttgaaaacattttagtgattttttctaaacttgtaacccgatcgaaattcaatccgaaccaaaaataacccgatcgaaagtgactcaacccaaaagcttccctgatctaattgtgatgatagctttgaaattttcatcgtttt

SEQ ID NO: 310 - DNA, 200 bp, Amaranthus palmeri
aaaacgatgaaaatttcaaagctatcatcacaattagatcagggaagcttttgggttgagtcactttcgatcgggttatttttggttcggattgaatttcgatcgggttacaagtttagaaaaaatcactaaaatgttttcaaaaaagacctaaacttttttattaaaaaagaataaatcatcttcatacccagtatatc

SEQ ID NO: 311 - DNA, 200 bp, Amaranthus palmeri
atagctttgaaattttcatcgttttagtcaaaaagttctgttgagtagtttaaataactggttcacattttgtaattatatgcaggattatgatctgctgagttctcgagcacaaagagaattggcggcgacaagcaatgtataaccctaagttgcttcgacatccgccatcgattttcattcgagatctggattgggaa

SEQ ID NO: 312 - DNA, 200 bp, Amaranthus palmeri
ttcccaatccagatctcgaatgaaaatcgatggcggatgtcgaagcaacttagggttatacattgcttgtcgccgccaattctctttgtgctcgagaactcagcagatcataatcctgcatataattacaaaatgtgaaccagttatttaaactactcaacagaactttttgactaaaacgatgaaaatttcaaagctat

SEQ ID NO: 313 - DNA, 200 bp, Amaranthus palmeri
tttcattcgagatctggattgggaatctgatcatcgaataacgatcagctgcaaacaaaattatgagggttgcatactggggctgttcaagttcttgatgtataaattctccagaaagaagatttatttgtaacgatatatagaaatatgtatagcttacttctagggaattatgtatgtgcaccatctgtaacttgatt

SEQ ID NO: 314 - DNA, 200 bp, Amaranthus palmeri
aatcaagttacagatggtgcacatacataattccctagaagtaagctatacatatttctatatatcgttacaaataaatcttctttctggagaatttatacatcaagaacttgaacagccccagtatgcaaccctcataattttgtttgcagctgatcgttattcgatgatcagattcccaatccagatctcgaatgaaa

SEQ ID NO: 315 - DNA, 200 bp, Amaranthus palmeri
tatgtgcaccatctgtaacttgattgaaatgtaagtatcaacttggtctcttgattgaaatgtaagtatcaacataatacaaatttataccaatacatttatttcccttttttgtttaattttgtgttttttgttgtttttaatttgtaactagactcactcatactccaacggtccgtctggttggtggtattaaatgg

SEQ ID NO: 316 - DNA, 200 bp, Amaranthus palmeri
ccatttaataccaccaaccagacggaccgttggagtatgagtgagtctagttacaaattaaaaacaacaaaaaacacaaaattaaacaaaaaagggaaataaatgtattggtataaatttgtattatgttgatacttacatttcaatcaagagaccaagttgatacttacatttcaatcaagttacagatggtgcacata

SEQ ID NO: 317 - DNA, 200 bp, Amaranthus palmeri
ccgtctggttggtggtattaaatggggtaatgagaataaaaattagtgtaattttggttaaaaaatctcttgctatcttgatggccatgcttgtatttgatgagaaggaatatgaaaactagtgtaggtggtattaaacagtgtcacggtggtagtgagaatgaaaactagtgtaatttgggttaaaaaatctcgtcttt

SEQ ID NO: 318 - DNA, 200 bp, Amaranthus palmeri
aaagacgagattttttaacccaaattacactagttttcattctcactaccaccgtgacactgtttaataccacctacactagttttcatattccttctcatcaaatacaagcatggccatcaagatagcaagagattttttaaccaaaattacactaatttttattctcattaccccatttaataccaccaaccagacgg

SEQ ID NO: 319 - DNA, 133 bp, Amaranthus palmeri; identical to SEQ ID NO: 15

SEQ ID NO: 320 - DNA, 133 bp, Amaranthus palmeri
agtattatgaaacggaaaaagtatataaatagtagcataagagttcatgcatttcaatatacacactccaactaatttggacttcgtcaactacaaaagagttgaaattctatttagatcaaatggagagtca

SEQ ID NO: 321 - DNA, 200 bp, Amaranthus palmeri
tgggttttaatattaatccagggagagggtctgggtcgtccatttattgttttgggacacgacattggaccagatccgttgagtctcaaaacattggactcatagcctaaaaataggtgtagggataggacatatccaataaagtcttggacccataagcgtacatccctaatatgtagtactagaatattttatatgtt

SEQ ID NO: 322 - DNA, 200 bp, Amaranthus palmeri
aacatataaaatattctagtactacatattagggatgtacgcttatgggtccaagactttattggatatgtcctatccctacacctatttttaggctatgagtccaatgttttgagactcaacggatctggtccaatgtcgtgtcccaaaacaataaatggacgacccagaccctctccctggattaatattaaaaccca

SEQ ID NO: 323 - DNA, 200 bp, Amaranthus palmeri
ttgaaagcctgctcgggcacgacactgtagggctcgggcgagcagcatcgcgttggggccagcatgatgagatgttcaaacacagaagttactggagtgctagtgcgcggcttacttttctttaattttgattctatctagaattctaactaaaccctaatgcttacgattgattagtataattaaaacccataaaatct

SEQ ID NO: 324 - DNA, 200 bp, Amaranthus palmeri
agattttatgggttttaattatactaatcaatcgtaagcattagggtttagttagaattctagatagaatcaaaattaaagaaaagtaagccgcgcactagcactccagtaacttctgtgtttgaacatctcatcatgctggccccaacgcgatgctgctcgcccgagccctacagtgtcgtgcccgagcaggctttcaa

SEQ ID NO: 325 - DNA, 200 bp, Amaranthus palmeri
agtataattaaaacccataaaatcttcagatttttcaccacaaaatatttgagcttagtaatctacaagaaatcttcaaacacatcaaatctagttgtctctcattctctattgtaattcttattattacgagttcttgtgttcaagaactacaagtttgattattaatcaacccaagaagttcgccaaggaggatgtag

SEQ ID NO: 326 - DNA, 200 bp, Amaranthus palmeri
ctacatcctccttggcgaacttcttgggttgattaataatcaaacttgtagttcttgaacacaagaactcgtaataataagaattacaatagagaatgagagacaactagatttgatgtgtttgaagatttcttgtagattactaagctcaaatattttgtggtgaaaaatctgaagattttatgggttttaattatact

SEQ ID NO: 327 - DNA, 200 bp, Amaranthus palmeri
aagaagttcgccaaggaggatgtagcccaaactgggtgaacctcggtaaatctttgaattcttccttgctttctactaattaattgcgaatgagtatgtaagatattgcattatatttttcatattcaacaaaagcattctactaccaatcttcgtcttgtaattcgcttttgcaacgttgtccttcaactagtgaatga

SEQ ID NO: 328 - DNA, 200 bp, Amaranthus palmeri
tcattcactagttgaaggacaacgttgcaaaagcgaattacaagacgaagattggtagtagaatgcttttgttgaatatgaaaaatataatgcaatatcttacatactcattcgcaattaattagtagaaagcaaggaagaattcaaagatttaccgaggttcacccagtttgggctacatcctccttggcgaacttctt

SEQ ID NO: 329 - DNA, 200 bp, Amaranthus palmeri
acgttgtccttcaactagtgaatgagttgttcaaatacttgacaattgatattatttgagtggtcgtggatgtagtgttgtaactaaattgtcacttatgagttaggaccatatccttgcaaaggtggagagatcacttggcagaattcggtgaaaagtagcacctttccatagatagtatagcgttatgagtgaattta

SEQ ID NO: 330 - DNA, 200 bp, Amaranthus palmeri
taaattcactcataacgctatactatctatggaaaggtgctacttttcaccgaattctgccaagtgatctctccacctttgcaaggatatggtcctaactcataagtgacaatttagttacaacactacatccacgaccactcaaataatatcaattgtcaagtatttgaacaactcattcactagttgaaggacaacgt

SEQ ID NO: 331 - DNA, 200 bp, Amaranthus palmeri
tagtatagcgttatgagtgaatttattatattgtgttgtcttatcagtgtaacataatttgtagctaattcgctttatgaattcggaattcgctcgaaattgttgaaaaatagcccaagaccgaccatattttgcttttttcgatttgcgatccgcagggagattagagaaccatgtaacattgtattttgatataattt

SEQ ID NO: 332 - DNA, 200 bp, Amaranthus palmeri
aaattatatcaaaatacaatgttacatggttctctaatctccctgcggatcgcaaatcgaaaaaagcaaaatatggtcggtcttgggctatttttcaacaatttcgagcgaattccgaattcataaagcgaattagctacaaattatgttacactgataagacaacacaatataataaattcactcataacgctatacta

SEQ ID NO: 333 - DNA, 200 bp, Amaranthus palmeri
gtaacattgtattttgatataatttttgaatttcattgtcagttgacatcttgaagctgttactacctgatacttggaaggaaatctcatacttcaaaaaacttgagaaattagtgggcgttcctgtgattaatgttcacatatggttagttaattcttcattctatattaaatttacttgttaggttttataccttatc

SEQ ID NO: 334 - DNA, 200 bp, Amaranthus palmeri
gataaggtataaaacctaacaagtaaatttaatatagaatgaagaattaactaaccatatgtgaacattaatcacaggaacgcccactaatttctcaagttttttgaagtatgagatttccttccaagtatcaggtagtaacagcttcaagatgtcaactgacaatgaaattcaaaaattatatcaaaatacaatgttac

SEQ ID NO: 335 - DNA, 200 bp, Amaranthus palmeri
tacttgttaggttttataccttatcaactgcttttagttttgacattttgtccgacaataagtgggcgtttctgttttgttgcgttttgtgaatttcttttgattacaggggctaattatataataatgcttcatgcaggtttgacagaaaattaaagaatacatatgaccatctactcttcagcaggttgtattttgtt

SEQ ID NO: 336 - DNA, 200 bp, Amaranthus palmeri
aacaaaatacaacctgctgaagagtagatggtcatatgtattctttaattttctgtcaaacctgcatgaagcattattatataattagcccctgtaatcaaaagaaattcacaaaacgcaacaaaacagaaacgcccacttattgtcggacaaaatgtcaaaactaaaagcagttgataaggtataaaacctaacaagta

SEQ ID NO: 337 - DNA, 200 bp, Amaranthus palmeri
actcttcagcaggttgtattttgtttctttaatcatccatttctctttcgtaacttaaataatctcgttcttccccttccctccttcacttcaacacttgtttcaattctttcattttcggtcgtagtaaaaattgatgtatatttgacaagagttgcatcataagtaatatgaacattggaggagtgacaatcatcatt

SEQ ID NO: 338 - DNA, 200 bp, Amaranthus palmeri
aatgatgattgtcactcctccaatgttcatattacttatgatgcaactcttgtcaaatatacatcaatttttactacgaccgaaaatgaaagaattgaaacaagtgttgaagtgaaggagggaaggggaagaacgagattatttaagttacgaaagagaaatggatgattaaagaaacaaaatacaacctgctgaagagt

SEQ ID NO: 339 - DNA, 200 bp, Amaranthus palmeri
cattggaggagtgacaatcatcatttatgaagtataaactaagattcctttaagaaggtgaaagtttaagtgaaaattttctttccattgggaaatagtcttttgattaacatcttgaatagatgaaggatgcgagtttttggaatgaagagaaatattttatgtgatctagttgagagtcgatggtgccttgaatttct

SEQ ID NO: 340 - DNA, 200 bp, Amaranthus palmeri
agaaattcaaggcaccatcgactctcaactagatcacataaaatatttctcttcattccaaaaactcgcatccttcatctattcaagatgttaatcaaaagactatttcccaatggaaagaaaattttcacttaaactttcaccttcttaaaggaatcttagtttatacttcataaatgatgattgtcactcctccaatg

SEQ ID NO: 341 - DNA, 200 bp, Amaranthus palmeri
agagtcgatggtgccttgaatttcttcaaaattgagcattttgtgaacgttcgctttatttttgcactttcatgtccttttcttaaaagtagtatatggcttttcattctcaacttaggcttacctcaatgcctaaacctttacaaacacacatcatataagaatgagtgttaaaatttacctcttcatctcagtaaagt

SEQ ID NO: 342 - DNA, 200 bp, Amaranthus palmeri
actttactgagatgaagaggtaaattttaacactcattcttatatgatgtgtgtttgtaaaggtttaggcattgaggtaagcctaagttgagaatgaaaagccatatactacttttaagaaaaggacatgaaagtgcaaaaataaagcgaacgttcacaaaatgctcaattttgaagaaattcaaggcaccatcgactct

SEQ ID NO: 343 - DNA, 200 bp, Amaranthus palmeri
gttttcctgggtgcgcacgggtgaggccaaagtgcgttaaaaagacttgtgttggtctgtggggcttgtctacagtctccatgagtagtcaccggcggtacgagaggccggggtgttacataaacagactcaaaggcgctaagccaagtagccaatagcaacatgtgtggcctgcggacagtcacaaaaacacacaattt

SEQ ID NO: 344 - DNA, 200 bp, Amaranthus palmeri
aaattgtgtgtttttgtgactgtccgcaggccacacatgttgctattggctacttggcttagcgcctttgagtctgtttatgtaacaccccggcctctcgtaccgccggtgactactcatggagactgtagacaagccccacagaccaacacaagtctttttaacgcactttggcctcacccgtgcgcacccaggaaaac

SEQ ID NO: 345 - DNA, 200 bp, Amaranthus palmeri
ggacagtcacaaaaacacacaatttcttatttttactctcttttatctcttttaggctttagccatcaacaataaaacaacatgataaagcaattcatttactgctaaattccaacaatttggtccctttttcctgttctttcagtttcacataccctcttatcaatctatatccaaaactatttcattttccaaactct

SEQ ID NO: 346 - DNA, 200 bp, Amaranthus palmeri
agagtttggaaaatgaaatagttttggatatagattgataagagggtatgtgaaactgaaagaacaggaaaaagggaccaaattgttggaatttagcagtaaatgaattgctttatcatgttgttttattgttgatggctaaagcctaaaagagataaaagagagtaaaaataagaaattgtgtgtttttgtgactgtcc

SEQ ID NO: 347 - DNA, 200 bp, Amaranthus palmeri
aaaactatttcattttccaaactcttttaaacccaaaaatcaaaacttttgattgaagaacaaactttgggggttttggaaaatgagtcattttggatatgcttgtgctactcaatccacatcaagatatgttcttttaggaaattcaaataaccccacttcaatttcatctattggaagtgattttttgggtcattctg

SEQ ID NO: 348 - DNA, 200 bp, Amaranthus palmeri
cagaatgacccaaaaaatcacttccaatagatgaaattgaagtggggttatttgaatttcctaaaagaacatatcttgatgtggattgagtagcacaagcatatccaaaatgactcattttccaaaacccccaaagtttgttcttcaatcaaaagttttgatttttgggtttaaaagagtttggaaaatgaaatagtttt

SEQ ID NO: 349 - DNA, 200 bp, Amaranthus palmeri
ggaagtgattttttgggtcattctgtgagaaatttcagtgttagtaaagtttatggaggaaagcaaagaaatgggcattgccctttaaaggttttctgccttttttttttttttgatgatttgattttctgggtagggataaatgataaagattgattcattttttttaaatgaataatttgtttttttgtatgatgcag

SEQ ID NO: 350 - DNA, 200 bp, Amaranthus palmeri
ctgcatcatacaaaaaaacaaattattcatttaaaaaaaatgaatcaatctttatcatttatccctacccagaaaatcaaatcatcaaaaaaaaaaaaaaggcagaaaacctttaaagggcaatgcccatttctttgctttcctccataaactttactaacactgaaatttctcacagaatgacccaaaaaatcacttcc

SEQ ID NO: 351 - DNA, 200 bp, Amaranthus palmeri
taatttgtttttttgtatgatgcaggttgtttgtatagattatcctaggccagagcttgaaagtacatccaatttcttggaagccgcctacttatcttctacttttcggaattcgcctcgtcctcagaagccattagaagttgtaattgctggagcaggtgagtggaagggttctttacctattctgttgattagggtct

SEQ ID NO: 352 - DNA, 200 bp, Amaranthus palmeri
agaccctaatcaacagaataggtaaagaacccttccactcacctgctccagcaattacaacttctaatggcttctgaggacgaggcgaattccgaaaagtagaagataagtaggcggcttccaagaaattggatgtactttcaagctctggcctaggataatctatacaaacaacctgcatcatacaaaaaaacaaatta

SEQ ID NO: 353 - DNA, 200 bp, Amaranthus palmeri
ttacctattctgttgattagggtcttgttgtgttgctttttgctttgccaaattggatgctgttcttgattttctggagctttgggcaaaatagaagcaaaattgaaagctaattgagtcaattgagatgtttttgagaaatcatttattggccgttactgtttattagagaaaaaatatgggtcaagaaacgaaaagat

SEQ ID NO: 354 - DNA, 200 bp, Amaranthus palmeri
atcttttcgtttcttgacccatattttttctctaataaacagtaacggccaataaatgatttctcaaaaacatctcaattgactcaattagctttcaattttgcttctattttgcccaaagctccagaaaatcaagaacagcatccaatttggcaaagcaaaaagcaacacaacaagaccctaatcaacagaataggtaa

SEQ ID NO: 355 - DNA, 200 bp, Amaranthus palmeri
aatatgggtcaagaaacgaaaagataatggaaaaactacttataggtgtcttttttgatcatgaatcatgatggatatatatggtgtcaactatcaagactgccatataactaatgtagtatgcttccttaaggggtggtgaagaatagacgtgtggatgagaaaattgctgggaatttcctatgcttatgtagaatgag

SEQ ID NO: 356 - DNA, 200 bp, Amaranthus palmeri
ctcattctacataagcataggaaattcccagcaattttctcatccacacgtctattcttcaccaccccttaaggaagcatactacattagttatatggcagtcttgatagttgacaccatatatatccatcatgattcatgatcaaaaaagacacctataagtagtttttccattatcttttcgtttcttgacccatatt

SEQ ID NO: 357 - DNA, 200 bp, Amaranthus palmeri
atttcctatgcttatgtagaatgagcttcctcttgttgacattagtgaaaagtgaaaaattggtgtatgagtttgcttgatcgcttttgtgagtgcttcattgtccgttccacacctaggttatgttgtagggttgcaatatgttaaattgttagtgacggctgtcgtataacattattgtatcttatgccatgggccaa

SEQ ID NO: 358 - DNA, 200 bp, Amaranthus palmeri
ttggcccatggcataagatacaataatgttatacgacagccgtcactaacaatttaacatattgcaaccctacaacataacctaggtgtggaacggacaatgaagcactcacaaaagcgatcaagcaaactcatacaccaatttttcacttttcactaatgtcaacaagaggaagctcattctacataagcataggaaat

SEQ ID NO: 359 - DNA, 200 bp, Amaranthus palmeri
tattgtatcttatgccatgggccaaatttacccctattcaacgacgccatgcagacctaggtgtagtgaaaagtatgcaagggttaattggacatcaagcatggcgccatgttgtttgagtgtggcaaaaagactttacgctacacctctagaccagttaagtatgtaaagggtgttgggtcaccgctctaaagtggtgt

SEQ ID NO: 360 - DNA, 200 bp, Amaranthus palmeri
acaccactttagagcggtgacccaacaccctttacatacttaactggtctagaggtgtagcgtaaagtctttttgccacactcaaacaacatggcgccatgcttgatgtccaattaacccttgcatacttttcactacacctaggtctgcatggcgtcgttgaataggggtaaatttggcccatggcataagatacaata

SEQ ID NO: 361 - DNA, 200 bp, Amaranthus palmeri
ttgggtcaccgctctaaagtggtgtgtcacattttatcgaattcgaggataagctgatcgtggtatcaagtgagaaagaacgcaatatagtggaattagaaagttaagtaataagaaaaaagaaaaaaatgatatctagctttaggaaaatctatcagtgaggagaatattgcaaaatacgtggaaattaaaaccaagac

SEQ ID NO: 362 - DNA, 200 bp, Amaranthus palmeri
gtcttggttttaatttccacgtattttgcaatattctcctcactgatagattttcctaaagctagatatcatttttttcttttttcttattacttaactttctaattccactatattgcgttctttctcacttgataccacgatcagcttatcctcgaattcgataaaatgtgacacaccactttagagcggtgacccaa

SEQ ID NO: 363 - DNA, 200 bp, Amaranthus palmeri
aatacgtggaaattaaaaccaagacaaagctagcgatatatgagacaaagttaaaaatgtacaaagaaatatacgataagttgactcgaaagaagaggataacgatctttataggatagcctaaaggagacaaatgattataaacgatactagttgaatgaactatgaagagtgtcttaaccaagcaaatattgtttaga

SEQ ID NO: 364 - DNA, 200 bp, Amaranthus palmeri
tctaaacaatatttgcttggttaagacactcttcatagttcattcaactagtatcgtttataatcatttgtctcctttaggctatcctataaagatcgttatcctcttctttcgagtcaacttatcgtatatttctttgtacatttttaactttgtctcatatatcgctagctttgtcttggttttaatttccacgtatt

SEQ ID NO: 365 - DNA, 200 bp, Amaranthus palmeri
cttaaccaagcaaatattgtttagaaataaattcaaaactttttaattcttcaaatatgaacatgagaactgacttctcattctttattttacttcaaggtttggctggtctatccacggcaaagtatttagctgatgcaggtcacaaacccatattgttggaagcacgagatgttttaggaggaaaggtgtgtgctata

SEQ ID NO: 366 - DNA, 200 bp, Amaranthus palmeri
tatagcacacacctttcctcctaaaacatctcgtgcttccaacaatatgggtttgtgacctgcatcagctaaatactttgccgtggatagaccagccaaaccttgaagtaaaataaagaatgagaagtcagttctcatgttcatatttgaagaattaaaaagttttgaatttatttctaaacaatatttgcttggttaag

SEQ ID NO: 367 - DNA, 200 bp, Amaranthus palmeri
tttaggaggaaaggtgtgtgctatacgtttctcgtagcttatgaaacaaattcatcgtgcttattctcttattagtttatttcagactatcagatcatttttgaactttttcctccctctgttcggctgtattattatatatgtgcagcatgattaaaaaatgggtgcattaacatatatgaagttttttttttttatca

SEQ ID NO: 368 - DNA, 200 bp, Amaranthus palmeri
tgataaaaaaaaaaaacttcatatatgttaatgcacccattttttaatcatgctgcacatatataataatacagccgaacagagggaggaaaaagttcaaaaatgatctgatagtctgaaataaactaataagagaataagcacgatgaatttgtttcataagctacgagaaacgtatagcacacacctttcctcctaaa

SEQ ID NO: 369 - DNA, 200 bp, Amaranthus palmeri
tatatgaagttttttttttttatcaaggcgagattttgtcatccaaaaactttacttctgaacgtgctgtatgatcctgtttctgtatcttcatttgctgggattttctcgaggttcctgactgctttcagttattgtagttacccatcctgcataaatttgagtttacagttattgtaatgaaaataaatcggctaatt

SEQ ID NO: 370 - DNA, 200 bp, Amaranthus palmeri
aattagccgatttattttcattacaataactgtaaactcaaatttatgcaggatgggtaactacaataactgaaagcagtcaggaacctcgagaaaatcccagcaaatgaagatacagaaacaggatcatacagcacgttcagaagtaaagtttttggatgacaaaatctcgccttgataaaaaaaaaaaacttcatata

SEQ ID NO: 371 - DNA, 200 bp, Amaranthus palmeri
tgtaatgaaaataaatcggctaattatatcctcgtcacagtatgatgaatcttgggctagtaagaaaatgaggtaggaggaataattatggttagtttgataatatgtgccaagagaaatattgtagtgtaaagtttcattgtatttcttcccgtgcttataatttttgctccacaggttgcagcgtggaaggatgagga

SEQ ID NO: 372 - DNA, 200 bp, Amaranthus palmeri
tcctcatccttccacgctgcaacctgtggagcaaaaattataagcacgggaagaaatacaatgaaactttacactacaatatttctcttggcacatattatcaaactaaccataattattcctcctacctcattttcttactagcccaagattcatcatactgtgacgaggatataattagccgatttattttcattaca

SEQ ID NO: 373 - DNA, 200 bp, Amaranthus palmeri
aggttgcagcgtggaaggatgaggatggtgactggtatgagactgggctacatatattctgtgagtgatcttctaattttctgcttaattggccagttacccatgttcttacaatgcgctctctagtcgtgtttattggaaaatcgatgtactgaacatcttcatattttcttgaagttggggcatatccaaatatccaa

SEQ ID NO: 374 - DNA, 200 bp, Amaranthus palmeri
ttggatatttggatatgccccaacttcaagaaaatatgaagatgttcagtacatcgattttccaataaacacgactagagagcgcattgtaagaacatgggtaactggccaattaagcagaaaattagaagatcactcacagaatatatgtagcccagtctcataccagtcaccatcctcatccttccacgctgcaacct

SEQ ID NO: 375 - DNA, 200 bp, Amaranthus palmeri
agttggggcatatccaaatatccaaaatctatttggagaacttggtataaatgaccgactgcaatggaaggagcactctatgatttttgcaatgcctagcaagcccggtgaattcagtcgctttgattttcccgaaatcctgcctgcaccattaaatggttagtatatcggtgataactgccaaattacttgatgcaatg

SEQ ID NO: 376 - DNA, 200 bp, Amaranthus palmeri
cattgcatcaagtaatttggcagttatcaccgatatactaaccatttaatggtgcaggcaggatttcgggaaaatcaaagcgactgaattcaccgggcttgctaggcattgcaaaaatcatagagtgctccttccattgcagtcggtcatttataccaagttctccaaatagattttggatatttggatatgccccaact

SEQ ID NO: 377 - DNA, 200 bp, Amaranthus palmeri
aactgccaaattacttgatgcaatgcagtaccttgttaagtactttggatgtgactccacctataatacttgctataatcttcaatttatttctctttcctacattagaaactataagtatcccgctaaaggacatgaccccacttacaaagttacaataccccattaaaatacccactcacccactttttttaatcggt

SEQ ID NO: 378 - DNA, 200 bp, Amaranthus palmeri
accgattaaaaaaagtgggtgagtgggtattttaatggggtattgtaactttgtaagtggggtcatgtcctttagcgggatacttatagtttctaatgtaggaaagagaaataaattgaagattatagcaagtattataggtggagtcacatccaaagtacttaacaaggtactgcattgcatcaagtaatttggcagtt

SEQ ID NO: 379 - DNA, 200 bp, Amaranthus palmeri
cactcacccactttttttaatcggtgtaccatccgcccgaggagcaatctcgaggggacagcagagtactactttagtgttattgtgatgaaataggtacctgcatcatatctcatgtcctgtggatacccataaatgaacgaaaaatttcatttttatacgtattatcctgctttagaagcttggaatatcattgaact

SEQ ID NO: 380 - DNA, 200 bp, Amaranthus palmeri
agttcaatgatattccaagcttctaaagcaggataatacgtataaaaatgaaatttttcgttcatttatgggtatccacaggacatgagatatgatgcaggtacctatttcatcacaataacactaaagtagtactctgctgtcccctcgagattgctcctcgggcggatggtacaccgattaaaaaaagtgggtgagtg

SEQ ID NO: 381 - DNA, 200 bp, Amaranthus palmeri
tagaagcttggaatatcattgaacttttttaatgtcccaacatgaaaacaatctgcatcttggtctgtttgctactcctaaatcctaatgagtcgggctgatttatgtctttgatgcttttgatcgtgtttcgcaggcatatgggcaatcctaaggaataatgaaatgctaacctggccagaaaaaatcaagtttgccat

SEQ ID NO: 382 - DNA, 200 bp, Amaranthus palmeri
atggcaaacttgattttttctggccaggttagcatttcattattccttaggattgcccatatgcctgcgaaacacgatcaaaagcatcaaagacataaatcagcccgactcattaggatttaggagtagcaaacagaccaagatgcagattgttttcatgttgggacattaaaaaagttcaatgatattccaagcttcta

SEQ ID NO: 383 - DNA, 200 bp, Amaranthus palmeri
ggccagaaaaaatcaagtttgccattggcttgttgcctgctatggcaggcggacagtcatatgttgaagcacaagatggtttgagtgtccaagagtggatgagaaaacaagtaggagcagactttcgtttcagattttcctcattttgttaatggttctagacttctagctgtaaactttgactttgttgggacgtcaat

SEQ ID NO: 384 - DNA, 200 bp, Amaranthus palmeri
attgacgtcccaacaaagtcaaagtttacagctagaagtctagaaccattaacaaaatgaggaaaatctgaaacgaaagtctgctcctacttgttttctcatccactcttggacactcaaaccatcttgtgcttcaacatatgactgtccgcctgccatagcaggcaacaagccaatggcaaacttgattttttctggcc

SEQ ID NO: 385 - DNA, 200 bp, Amaranthus palmeri
actttgactttgttgggacgtcaatgctgaaattttgtttgtgcattaatgcagggagtacccgatcgtgtaactgatgatgtgtttattgccatgtcaaaggcactgaacttcataaatcctgatgaactttcaatgcagtgcatcttgattgctctgaaccgattcctgcaggcatgactgcctttcattttctgctt

SEQ ID NO: 386 - DNA, 200 bp, Amaranthus palmeri
aagcagaaaatgaaaggcagtcatgcctgcaggaatcggttcagagcaatcaagatgcactgcattgaaagttcatcaggatttatgaagttcagtgcctttgacatggcaataaacacatcatcagttacacgatcgggtactccctgcattaatgcacaaacaaaatttcagcattgacgtcccaacaaagtcaaagt

SEQ ID NO: 387 - DNA, 200 bp, Amaranthus palmeri
catgactgcctttcattttctgctttaaatttttggttttgtacgatacttcttagtgcttgtttttgcgactattctcgagtaaataggggatataaaatgaccgtgctgtttttcataaactgaccttgggtaatgtatatcaacaggagaaacatggttctaagatggccttcctagacggaaaccctccagagagg

SEQ ID NO: 388 - DNA, 200 bp, Amaranthus palmeri
cctctctggagggtttccgtctaggaaggccatcttagaaccatgtttctcctgttgatatacattacccaaggtcagtttatgaaaaacagcacggtcattttatatcccctatttactcgagaatagtcgcaaaaacaagcactaagaagtatcgtacaaaaccaaaaatttaaagcagaaaatgaaaggcagtcatg

SEQ ID NO: 389 - DNA, 200 bp, Amaranthus palmeri
cctagacggaaaccctccagagaggctgtgcatgcctattgttaagcacatcgagtcactaggtggtgaagttaaactaaattctcgtatacaaaagattcagttggaccagagtggaagcgtgaagagttttttgctaaataacgggagggaaatacgaggagatgcctatgtttttgccaccccaggttttcttctct

SEQ ID NO: 390 - DNA, 200 bp, Amaranthus palmeri
agagaagaaaacctggggtggcaaaaacataggcatctcctcgtatttccctcccgttatttagcaaaaaactcttcacgcttccactctggtccaactgaatcttttgtatacgagaatttagtttaacttcaccacctagtgactcgatgtgcttaacaataggcatgcacagcctctctggagggtttccgtctagg

SEQ ID NO: 391 - DNA, 200 bp, Amaranthus palmeri
tttgccaccccaggttttcttctctccctttttttaccattagttctctatcagactccgtaaaagctagagtaaagaaaatgaagattctattacagaaatggacacactgtaaagcttaattagttttgatcttgggcaaagcatttgtgtttccaaatttgttaatggttattatttaaatagaacacttatgtttg

SEQ ID NO: 392 - DNA, 200 bp, Amaranthus palmeri
caaacataagtgttctatttaaataataaccattaacaaatttggaaacacaaatgctttgcccaagatcaaaactaattaagctttacagtgtgtccatttctgtaatagaatcttcattttctttactctagcttttacggagtctgatagagaactaatggtaaaaaaagggagagaagaaaacctggggtggcaaa

SEQ ID NO: 393 - DNA, 200 bp, Amaranthus palmeri
tatttaaatagaacacttatgtttgtgatgggtaacaaactaacaataggtcaagcgttgagccaaagtgttataacaatgattatatagtgtatatcatagtgtaaaattgcggtaaattgtggtaatggacgcaatcacagtgtcgggagtgattcggtatcataacgcctaaatatcggtcgaaaccataagctttg

SEQ ID NO: 394 - DNA, 200 bp, Amaranthus palmeri
caaagcttatggtttcgaccgatatttaggcgttatgataccgaatcactcccgacactgtgattgcgtccattaccacaatttaccgcaattttacactatgatatacactatataatcattgttataacactttggctcaacgcttgacctattgttagtttgttacccatcacaaacataagtgttctatttaaata

SEQ ID NO: 395 - DNA, 200 bp, Amaranthus palmeri
atatcggtcgaaaccataagctttgaaacggcccaaaacacggttttttttaaaaactttacgacgcgagaaatatcgttttgtttattttgaaaacctttacgaagcgacgatgcgatgcagccttgttttaactctatagtgtacataggaatatacaattaagcaaatagtcgtaagtgatatctcaaaagggacaa

SEQ ID NO: 396 - DNA, 200 bp, Amaranthus palmeri
ttgtcccttttgagatatcacttacgactatttgcttaattgtatattcctatgtacactatagagttaaaacaaggctgcatcgcatcgtcgcttcgtaaaggttttcaaaataaacaaaacgatatttctcgcgtcgtaaagtttttaaaaaaaaccgtgttttgggccgtttcaaagcttatggtttcgaccgatat

SEQ ID NO: 397 - DNA, 200 bp, Amaranthus palmeri
gtaagtgatatctcaaaagggacaagtgtgaaataggctaaagagttgaattaattgtgggattgacaattgtttcatcactggtcctctattgctttccttggtaaaatgttgcatacttgtttattgatttacactacatataattagttctgtagaatatgttcttgagtcaaagcatgggtcgatgtttgaggttg

SEQ ID NO: 398 - DNA, 200 bp, Amaranthus palmeri
caacctcaaacatcgacccatgctttgactcaagaacatattctacagaactaattatatgtagtgtaaatcaataaacaagtatgcaacattttaccaaggaaagcaatagaggaccagtgatgaaacaattgtcaatcccacaattaattcaactctttagcctatttcacacttgtcccttttgagatatcacttac

SEQ ID NO: 399 - DNA, 200 bp, Amaranthus palmeri
aagcatgggtcgatgtttgaggttgatgttggatttgcttgggcaagcaattacgaatatcttggtttaaggaacccatgaaaatggagcagcttgcaacgaaaacaaagcccagttgaaagcctgctcgggtgagcagcatcgcgttggggccagcatgatgagctgttcaaacacagaagttactggagtgctagtgc

SEQ ID NO: 400 - DNA, 200 bp, Amaranthus palmeri
gcactagcactccagtaacttctgtgtttgaacagctcatcatgctggccccaacgcgatgctgctcacccgagcaggctttcaactgggctttgttttcgttgcaagctgctccattttcatgggttccttaaaccaagatattcgtaattgcttgcccaagcaaatccaacatcaacctcaaacatcgacccatgctt

SEQ ID NO: 401 - DNA, 200 bp, Amaranthus palmeri
acagaagttactggagtgctagtgctctggcaagcaagcacagcgcagcttacttttctttaatttttgattctatctagaattctaactaaaccctaatgcttacgattgattagtataattaaaacccataaagtgaatgagttgttcaaatacttgacaattgacattatttgagtggtcgtggatgtagtgttgta

SEQ ID NO: 402 - DNA, 200 bp, Amaranthus palmeri
tacaacactacatccacgaccactcaaataatgtcaattgtcaagtatttgaacaactcattcactttatgggttttaattatactaatcaatcgtaagcattagggtttagttagaattctagatagaatcaaaaattaaagaaaagtaagctgcgctgtgcttgcttgccagagcactagcactccagtaacttctgt

SEQ ID NO: 403 - DNA, 200 bp, Amaranthus palmeri
gagtggtcgtggatgtagtgttgtaacaaaattgtcacttatgagttaggaccatatccttgcgaaggtggagatacacttggtagaatacggtgaaaagtatcacctttccatagatagtatagcgttataagtgaatttattatattgtgctgtcatatcagtgtaacataatttgtagctaatccgctttttgaata

SEQ ID NO: 404 - DNA, 200 bp, Amaranthus palmeri
tattcaaaaagcggattagctacaaattatgttacactgatatgacagcacaatataataaattcacttataacgctatactatctatggaaaggtgatacttttcaccgtattctaccaagtgtatctccaccttcgcaaggatatggtcctaactcataagtgacaattttgttacaacactacatccacgaccactc

SEQ ID NO: 405 - DNA, 200 bp, Amaranthus palmeri
ttgtagctaatccgctttttgaatacggaattcgctcgaaattgttgaaaaataacccaagaccgaccatattttgcttttttcggtttgcgattcgcagggagattagagaaccatgtaacattgtattttgatataatttttgaatttcattgtcagttgacatcttgaagctgttactacccgatacttggaaggaa

SEQ ID NO: 406 - DNA, 200 bp, Amaranthus palmeri
ttccttccaagtatcgggtagtaacagcttcaagatgtcaactgacaatgaaattcaaaaattatatcaaaatacaatgttacatggttctctaatctccctgcgaatcgcaaaccgaaaaaagcaaaatatggtcggtcttgggttatttttcaacaatttcgagcgaattccgtattcaaaaagcggattagctacaa

SEQ ID NO: 407 - DNA, 200 bp, Amaranthus palmeri
gttactacccgatacttggaaggaaatctcatacttcaaaaagcttgagaaattagtgggcgttcctgtgattaatgttcacatatggttagttaattcttcattctatattaaatttacttgttaggttttatacctaatcaactgcttttagttttgacattttgtccgacaataagtggacgtttctgttttgttgc

SEQ ID NO: 408 - DNA, 200 bp, Amaranthus palmeri
gcaacaaaacagaaacgtccacttattgtcggacaaaatgtcaaaactaaaagcagttgattaggtataaaacctaacaagtaaatttaatatagaatgaagaattaactaaccatatgtgaacattaatcacaggaacgcccactaatttctcaagctttttgaagtatgagatttccttccaagtatcgggtagtaac

SEQ ID NO: 409 - DNA, 200 bp, Amaranthus palmeri
taagtggacgtttctgttttgttgcgttttgtgaatttcttttgattacaggggctaattatataataatgcttcatgcaggtttgacagaaaattaaagaatacatatgaccatctactcttcagcaggtagtatttcgtttctttaatcatcctatttctctttcgtaacttaaataatctcgttcttccccttccct

SEQ ID NO: 410 - DNA, 200 bp, Amaranthus palmeri
agggaaggggaagaacgagattatttaagttacgaaagagaaataggatgattaaagaaacgaaatactacctgctgaagagtagatggtcatatgtattctttaattttctgtcaaacctgcatgaagcattattatataattagcccctgtaatcaaaagaaattcacaaaacgcaacaaaacagaaacgtccactta

SEQ ID NO: 411 - DNA, 200 bp, Amaranthus palmeri
aataatctcgttcttccccttccctccttcacttcaacacttgtttcaattcttcatttttggtcgtagtaaaaactgatgaatatttgacaagagtcgcatcataagtaatatgaacattggaggagtgacaatcatcatctatgaagtataaactaagattctttgaagaaggggaaagtttaagtgaaaattttctt

SEQ ID NO: 412 - DNA, 200 bp, Amaranthus palmeri
aagaaaattttcacttaaactttccccttcttcaaagaatcttagtttatacttcatagatgatgattgtcactcctccaatgttcatattacttatgatgcgactcttgtcaaatattcatcagtttttactacgaccaaaaatgaagaattgaaacaagtgttgaagtgaaggagggaaggggaagaacgagattatt

SEQ ID NO: 413 - DNA, 200 bp, Amaranthus palmeri
ggaaagtttaagtgaaaattttctttccattgggaaataagtcttttgattaacgtcttgaatagatgaaggatgcgaatttttggattcaaatgaagagaaacgttttatgtgatctagttgcgagtcgatggtgccttgaatttcttcaaaattgagcattttgttaatgttcgctttatttttgcactttcatgtcc

SEQ ID NO: 414 - DNA, 200 bp, Amaranthus palmeri
ggacatgaaagtgcaaaaataaagcgaacattaacaaaatgctcaattttgaagaaattcaaggcaccatcgactcgcaactagatcacataaaacgtttctcttcatttgaatccaaaaattcgcatccttcatctattcaagacgttaatcaaaagacttatttcccaatggaaagaaaattttcacttaaactttcc

SEQ ID NO: 415 - DNA, 200 bp, Amaranthus palmeri
gctttatttttgcactttcatgtccttttcttaaagttttatatggctatacattctcaatttagggcgacctcgatgcttaaacctttacaaacacacatcatataagaatgagagtgttaaaatttacctcttaatctcagtataaagtgtctcctttacttttgcacaaattttaggaacgtgtaagttaggataca

SEQ ID NO: 416 - DNA, 200 bp, Amaranthus palmeri
tgtatcctaacttacacgttcctaaaatttgtgcaaaagtaaaggagacactttatactgagattaagaggtaaattttaacactctcattcttatatgatgtgtgtttgtaaaggtttaagcatcgaggtcgccctaaattgagaatgtatagccatataaaactttaagaaaaggacatgaaagtgcaaaaataaagc

SEQ ID NO: 417 - DNA, 200 bp, Amaranthus palmeri
ttaggaacgtgtaagttaggatacaaattgaagttagggaatcttgtagggctcataaaaaatgacaatcacaaataactttctaaatatcgaaatgggtcacttgtggtgaactgatccaatatgaaaattagacacttgtgctaagatggagcaagtattataacttatgaaaacataatacttggggtggatgtacc

SEQ ID NO: 418 - DNA, 200 bp, Amaranthus palmeri
ggtacatccaccccaagtattatgttttcataagttataatacttgctccatcttagcacaagtgtctaattttcatattggatcagttcaccacaagtgacccatttcgatatttagaaagttatttgtgattgtcattttttatgagccctacaagattccctaacttcaatttgtatcctaacttacacgttcctaa

SEQ ID NO: 419 - DNA, 200 bp, Amaranthus palmeri
acataatacttggggtggatgtacctttggtaggaaccatagtgccaaaatgcaattaacggttgcaattgcggtaacgacacgatgatgcgtttatcataactccaaatatcggctaaaagcatgagatattccttgtaccggcccaaaacacggtttttttacaccttcacatcacgagaaatatcgtttttttgaaa

SEQ ID NO: 420 - DNA, 200 bp, Amaranthus palmeri
tttcaaaaaaacgatatttctcgtgatgtgaaggtgtaaaaaaaccgtgttttgggccggtacaaggaatatctcatgcttttagccgatatttggagttatgataaacgcatcatcgtgtcgttaccgcaattgcaaccgttaattgcattttggcactatggttcctaccaaaggtacatccaccccaagtattatgt

SEQ ID NO: 421 - DNA, 200 bp, Amaranthus palmeri
cacgagaaatatcgtttttttgaaaatctttagaacacggccgatgcattgcgatgcgaccttatttttgcactatggtagggacaacatttgcggatgcacacattggataccgtttctgacccccttttcacttttacagatcctatggatataagtatgttactgattctaaaacttcattccctaggattaaatgt

SEQ ID NO: 422 - DNA, 200 bp, Amaranthus palmeri
acatttaatcctagggaatgaagttttagaatcagtaacatacttatatccataggatctgtaaaagtgaaaagggggtcagaaacggtatccaatgtgtgcatccgcaaatgttgtccctaccatagtgcaaaaataaggtcgcatcgcaatgcatcggccgtgttctaaagattttcaaaaaaacgatatttctcgtg

SEQ ID NO: 423 - DNA, 200 bp, Amaranthus palmeri
aacttcattccctaggattaaatgtagaaaccatataaggatggatctttaagatacttttatctatatcctttcctgaaccctattaaatatctatggcctacaagaggtggtcacaattcatcatcctcttcgtccacttcatgcattttaaacatatcttcgagttctcctttaattgtttatctttgttatttcag

SEQ ID NO: 424 - DNA, 200 bp, Amaranthus palmeri
ctgaaataacaaagataaacaattaaaggagaactcgaagatatgtttaaaatgcatgaagtggacgaagaggatgatgaattgtgaccacctcttgtaggccatagatatttaatagggttcaggaaaggatatagataaaagtatcttaaagatccatccttatatggtttctacatttaatcctagggaatgaagtt

SEQ ID NO: 425 - DNA, 200 bp, Amaranthus palmeri
taattgtttatctttgttatttcaggagtcctcttttgagtgtctatgctgatatgtcggagacatgcaaggtgagcatattcccatttgtcgctcttttgatttctgacttgtatgttctggttctccatttgtcgctctttcgcgcgtataatttcgaatgttagccactccccgtcactcctcccattctgcaatca

SEQ ID NO: 426 - DNA, 200 bp, Amaranthus palmeri
tgattgcagaatgggaggagtgacggggagtggctaacattcgaaattatacgcgcgaaagagcgacaaatggagaaccagaacatacaagtcagaaatcaaaagagcgacaaatgggaatatgctcaccttgcatgtctccgacatatcagcatagacactcaaaagaggactcctgaaataacaaagataaacaatta

SEQ ID NO: 427 - DNA, 200 bp, Amaranthus palmeri
cgtcactcctcccattctgcaatcaccgggattttaactatgagggtccttagaatcgattataaaaattcgacaaaaacaaaaaaaaaagacataaaattgacgggccataacaattttacataagatattcaacattttttttgcgaattttcttaataaattccgtaattccgtacatctatactcccgagcccctt

SEQ ID NO: 428 - DNA, 200 bp, Amaranthus palmeri
aaggggctcgggagtatagatgtacggaattacggaatttattaagaaaattcgcaaaaaaaatgttgaatatcttatgtaaaattgttatggcccgtcaattttatgtcttttttttttgtttttgtcgaatttttataatcgattctaaggaccctcatagttaaaatcccggtgattgcagaatgggaggagtgacg

SEQ ID NO: 429 - DNA, 200 bp, Amaranthus palmeri
gtacatctatactcccgagccccttcatgtgtgcgctgcggctttaagaaacctttcttataagtgttgactgtatgagctgacaggctgtcttttccgtcccaataatcatttacaggaatataaggatccaaatagatccatgctggaactggtttttgcacccgcggaggaatggatttctcgaagcgacactgata

SEQ ID NO: 430 - DNA, 200 bp, Amaranthus palmeri
tatcagtgtcgcttcgagaaatccattcctccgcgggtgcaaaaaccagttccagcatggatctatttggatccttatattcctgtaaatgattattgggacggaaaagacagcctgtcagctcatacagtcaacacttataagaaaggtttcttaaagccgcagcgcacacatgaaggggctcgggagtatagatgtac

SEQ ID NO: 431 - DNA, 200 bp, Amaranthus palmeri
tggatttctcgaagcgacactgatattatcgaggcaacaatgaaagagcttgccaagcttttcccggatgaaatcgctgccgatggaagcaaggccaagatcctcaaatatcatgtcgtcaaaactccaaggtgattgataagcttgtgaaattaaaattggataattttatgctaccgctagaaacagcattaatgttg

SEQ ID NO: 432 - DNA, 200 bp, Amaranthus palmeri
caacattaatgctgtttctagcggtagcataaaattatccaattttaatttcacaagcttatcaatcaccttggagttttgacgacatgatatttgaggatcttggccttgcttccatcggcagcgatttcatccgggaaaagcttggcaagctctttcattgttgcctcgataatatcagtgtcgcttcgagaaatcca

SEQ ID NO: 433 - DNA, 200 bp, Amaranthus palmeri
accgctagaaacagcattaatgttgtgcccgcgggctcttttataggtcggtttataagactgtaccggattgtgaaccttgtcggccgctgcaaagatcaccaatagagggtttctatttagctggtgattacacaaaacaaaaatatttggcttctatggaaggtgctgtcttatctgggaagctttgtgcacaggct

SEQ ID NO: 434 - DNA, 200 bp, Amaranthus palmeri
agcctgtgcacaaagcttcccagataagacagcaccttccatagaagccaaatatttttgttttgtgtaatcaccagctaaatagaaaccctctattggtgatctttgcagcggccgacaaggttcacaatccggtacagtcttataaaccgacctataaaagagcccgcgggcacaacattaatgctgtttctagcggt

SEQ ID NO: 435 - DNA, 200 bp, Amaranthus palmeri
atctgggaagctttgtgcacaggctatcgtacaggtaatcaaattttgatggaacaccgcgtgcatgctgagtagactttttgtgttttgatttgttctgaaattgacccaaaaccgaccggaaatcatgggttataactcggaaaatatgacccgtaacctgaaaatgactcaaaacccaccgtagcccaaatccaacc

SEQ ID NO: 436 - DNA, 200 bp, Amaranthus palmeri
ggttggatttgggctacggtgggttttgagtcattttcaggttacgggtcatattttccgagttataacccatgatttccggtcggttttgggtcaatttcagaacaaatcaaaacacaaaaagtctactcagcatgcacgcggtgttccatcaaaatttgattacctgtacgatagcctgtgcacaaagcttcccagat

SEQ ID NO: 437 - DNA, 200 bp, Amaranthus palmeri
aacccaccgtagcccaaatccaaccgtttcgacttgtttacctaattttgtcaacttttcttgttccacatcgttaattttctgtcggaacccactttctttctagtctatttttgtatttcttttttctttgttgattcttttattcgtttatacctagttatgttttttttttttgaaaatttggaatagattaataa

SEQ ID NO: 438 - DNA, 200 bp, Amaranthus palmeri
ttattaatctattccaaattttcaaaaaaaaaaaacataactaggtataaacgaataaaagaatcaacaaagaaaaaagaaatacaaaaatagactagaaagaaagtgggttccgacagaaaattaacgatgtggaacaagaaaagttgacaaaattaggtaaacaagtcgaaacggttggatttgggctacggtgggtt

SEQ ID NO: 439 - DNA, 200 bp, Amaranthus palmeri
ttgaaaatttggaatagattaataaaaggaggaaaagaaacacaacactgtaacttgggacaccaaacctagttatgtttatatatttatatgtattttatatatttatatgcttttgactactgaggtattatgatagtttctatgagcgtgatatactgggtatgaagatgatttattcttttttaataaaaaagttt

SEQ ID NO: 440 - DNA, 200 bp, Amaranthus palmeri
aaacttttttattaaaaaagaataaatcatcttcatacccagtatatcacgctcatagaaactatcataatacctcagtagtcaaaagcatataaatatataaaatacatataaatatataaacataactaggtttggtgtcccaagttacagtgttgtgtttcttttcctccttttattaatctattccaaattttcaa

SEQ ID NO: 441 - DNA, 200 bp, Amaranthus palmeri
ttattcttttttaataaaaaagtttaggtcttttttgaaaacattttagtgattttttctaaacttgtaacccgatcgaaattcaatccgaaccaaaaataacccgatcgaaagtgactcaacccaaaagcttccctgatctaattgtgatgatagctttgaaattttcatcgttttagtcaaaaagttctgttgagtag

SEQ ID NO: 442 - DNA, 200 bp, Amaranthus palmeri
ctactcaacagaactttttgactaaaacgatgaaaatttcaaagctatcatcacaattagatcagggaagcttttgggttgagtcactttcgatcgggttatttttggttcggattgaatttcgatcgggttacaagtttagaaaaaatcactaaaatgttttcaaaaaagacctaaacttttttattaaaaaagaataa

SEQ ID NO: 443 - DNA, 200 bp, Amaranthus palmeri
ttagtcaaaaagttctgttgagtagtttaaataactggttcacattttgtaattatatgcaggattatgatctgctgagttctcgagcacaaagagaattggcggcgacaagcaatgtataaccctaagttgcttcgacatccgccatcgattttcattcgagatctggattgggaatctgatcatcgaataacgatcag

SEQ ID NO: 444 - DNA, 200 bp, Amaranthus palmeri
ctgatcgttattcgatgatcagattcccaatccagatctcgaatgaaaatcgatggcggatgtcgaagcaacttagggttatacattgcttgtcgccgccaattctctttgtgctcgagaactcagcagatcataatcctgcatataattacaaaatgtgaaccagttatttaaactactcaacagaactttttgactaa

SEQ ID NO: 445 - DNA, 200 bp, Amaranthus palmeri
aatctgatcatcgaataacgatcagctgcaaacaaaattatgagggttgcatactggggctgttcaagttcttgatgtataaattctccagaaagaagatttatttgtaacgatatatagaaatatgtatagcttacttctagggaattatgtatgtgcaccatctgtaacttgattgaaatgtaagtatcaacttggtc

SEQ ID NO: 446 - DNA, 200 bp, Amaranthus palmeri
gaccaagttgatacttacatttcaatcaagttacagatggtgcacatacataattccctagaagtaagctatacatatttctatatatcgttacaaataaatcttctttctggagaatttatacatcaagaacttgaacagccccagtatgcaaccctcataattttgtttgcagctgatcgttattcgatgatcagatt

SEQ ID NO: 447 - DNA, 200 bp, Amaranthus palmeri
ttgaaatgtaagtatcaacttggtctcttgattgaaatgtaagtatcaacataatacaaatttataccaatacatttatttcccttttttgtttaattatgtgttttttgttgttttttatttgtaactagagtcactcatactccaacggtctgtctggtttgtggtattaaacggtggtgatgagaataaaaactagt

SEQ ID NO: 448 - DNA, 200 bp, Amaranthus palmeri
actagtttttattctcatcaccaccgtttaataccacaaaccagacagaccgttggagtatgagtgactctagttacaaataaaaaacaacaaaaaacacataattaaacaaaaaagggaaataaatgtattggtataaatttgtattatgttgatacttacatttcaatcaagagaccaagttgatacttacatttcaa

SEQ ID NO: 449 - DNA, 200 bp, Amaranthus palmeri
ggtggtgatgagaataaaaactagtgtaattttgattaaaaattctcttgctattttgatggccatggttgtgtttgatgagaaggaatatgaaaactagtgtaggtggtattaaacagtgccacggtggtaatgagaatgaaaactagtgtaatttgggttaaaaaaatctcttgtctttaatcatctcattttcttta

SEQ ID NO: 450 - DNA, 200 bp, Amaranthus palmeri
taaagaaaatgagatgattaaagacaagagatttttttaacccaaattacactagttttcattctcattaccaccgtggcactgtttaataccacctacactagttttcatattccttctcatcaaacacaaccatggccatcaaaatagcaagagaatttttaatcaaaattacactagtttttattctcatcaccacc

SEQ ID NO: 451 - DNA, 200 bp, Amaranthus palmeri
gtctttaatcatctcattttctttataaatttcaatccaatgcattactatcgggagagatggtatcaggtggtaatggaaatttgtaaataaaaagaaaaattttgtgatcaaagtttcatcgctataaagcattctcattaccaccatttagtaccactaatcaaacaggccgcaagagctttagcgttggcttccat

SEQ ID NO: 452 - DNA, 200 bp, Amaranthus palmeri
atggaagccaacgctaaagctcttgcggcctgtttgattagtggtactaaatggtggtaatgagaatgctttatagcgatgaaactttgatcacaaaatttttctttttatttacaaatttccattaccacctgataccatctctcccgatagtaatgcattggattgaaatttataaagaaaatgagatgattaaagac

SEQ ID NO: 453 - DNA, 200 bp, Amaranthus palmeri
caagagctttagcgttggcttccattggatgattatgggggttaacgagtctgttaaggtgcccattattatctatatgtagttgtcttccattgaaacttgataagtaacttctaccattaccaagtgtttgtatatgaatcattttttttttctctttgtctgggttgttcagactcacttttaaaattcttcttcat

SEQ ID NO: 454 - DNA, 200 bp, Amaranthus palmeri
atgaagaagaattttaaaagtgagtctgaacaacccagacaaagagaaaaaaaaaatgattcatatacaaacacttggtaatggtagaagttacttatcaagtttcaatggaagacaactacatatagataataatgggcaccttaacagactcgttaacccccataatcatccaatggaagccaacgctaaagctcttg

SEQ ID NO: 455 - DNA, 200 bp, Amaranthus palmeri
actcacttttaaaattcttcttcattagcaagtccattagacttgtttcagtgcacttctgattatagtgtaaacagaaacaaggttgcatcacatcaaccacgttgtaaagattttcaaaacagacgaattgatatttttcgcgttaccgcatttttacatatcaagtagctgtttattcaaggattaacaactcatat

SEQ ID NO: 456 - DNA, 200 bp, Amaranthus palmeri
atatgagttgttaatccttgaataaacagctacttgatatgtaaaaatgcggtaacgcgaaaaatatcaattcgtctgttttgaaaatctttacaacgtggttgatgtgatgcaaccttgtttctgtttacactataatcagaagtgcactgaaacaagtctaatggacttgctaatgaagaagaattttaaaagtgagt

SEQ ID NO: 457 - DNA, 200 bp, Amaranthus palmeri
ttattcaaggattaacaactcatataaagtatcataagcttatcaatatctttatgatttatgaatggagtaataagagaagttaacttatcttggtttagactcttgagcggagccgtacaattacaaatcattgacatacatgatacattgcatagggacccatcaaaaaatcaaaaaggaagacgattgatcctaaa

SEQ ID NO: 458 - DNA, 200 bp, Amaranthus palmeri
tttaggatcaatcgtcttcctttttgattttttgatgggtccctatgcaatgtatcatgtatgtcaatgatttgtaattgtacggctccgctcaagagtctaaaccaagataagttaacttctcttattactccattcataaatcataaagatattgataagcttatgatactttatatgagttgttaatccttgaataa

SEQ ID NO: 459 - DNA, 200 bp, Amaranthus palmeri
aaaaaggaagacgattgatcctaaacggaaacgaatgaaattaaaagagagtaaaaaaaacacattaattttagaggttttatatattttatatattttttttgtaattttagagcctaaaaataagttattatactccgtcaaagttagtataaactaacgttaacaaatatttgaagctcccttaatttatggagttc

SEQ ID NO: 460 - DNA, 200 bp, Amaranthus palmeri
gaactccataaattaagggagcttcaaatatttgttaacgttagtttatactaactttgacggagtataataacttatttttaggctctaaaattacaaaaaaaatatataaaatatataaaacctctaaaattaatgtgttttttttactctcttttaatttcattcgtttccgtttaggatcaatcgtcttccttttt

SEQ ID NO: 461 - DNA, 200 bp, Amaranthus palmeri
gaagctcccttaatttatggagttctatgtgattggacatcttacacatgctcagaaccacacctgaatacaaaatatcaatataattctggtatccgagctgatagttcgatcaaaaattaaaaaggtgggtccaaaaagaatgttgtccctaccctaagggctaacagtgtgtttggcaagagggacttgaggttggg

SEQ ID NO: 462 - DNA, 200 bp, Amaranthus palmeri
cccaacctcaagtccctcttgccaaacacactgttagcccttagggtagggacaacattctttttggacccacctttttaatttttgatcgaactatcagctcggataccagaattatattgatattttgtattcaggtgtggttctgagcatgtgtaagatgtccaatcacatagaactccataaattaagggagcttc

SEQ ID NO: 463 - DNA, 200 bp, Amaranthus palmeri
ttggcaagagggacttgaggttggggaatgagatttttgggtaagattataaaaagtctcttatttgtttaaggggattgagaaaagatgagacttgagacttagaaaggaaaagtccccaaaaaatgtcttggtgggagggcagtatttggggatgaaacttagaaaatttataaaaagacaattttgccataaatgta

SEQ ID NO: 464 - DNA, 200 bp, Amaranthus palmeri
tacatttatggcaaaattgtctttttataaattttctaagtttcatccccaaatactgccctcccaccaagacattttttggggacttttcctttctaagtctcaagtctcatcttttctcaatccccttaaacaaataagagactttttataatcttacccaaaaatctcattccccaacctcaagtccctcttgccaa

SEQ ID NO: 465 - DNA, 200 bp, Amaranthus palmeri
aaaagacaattttgccataaatgtaaagaaatctaagagttataaggacaattttgtaaatataatcgatttttatttaatttcttatctatttttatcatttgactgacaacgacataagacatttattttcaaagtctcaactcaagtctcaacctaaagtctcattctaagtctcgactataatctcataatttcca

SEQ ID NO: 466 - DNA, 200 bp, Amaranthus palmeri
tggaaattatgagattatagtcgagacttagaatgagactttaggttgagacttgagttgagactttgaaaataaatgtcttatgtcgttgtcagtcaaatgataaaaatagataagaaattaaataaaaatcgattatatttacaaaattgtccttataactcttagatttctttacatttatggcaaaattgtctttt

SEQ ID NO: 467 - DNA, 200 bp, Amaranthus palmeri
ctcgactataatctcataatttccattcccacatgccaaacaccccctaattgattactcccacgttcaaacttgacgggattcacatgtaaaagaaaatgttgagacagtttatcccatattgataaattaaagatgttgtgcacactttataattcattaaaactagaggtgctcattcgggtcatcgggttgatttc

SEQ ID NO: 468 - DNA, 200 bp, Amaranthus palmeri
gaaatcaacccgatgacccgaatgagcacctctagttttaatgaattataaagtgtgcacaacatctttaatttatcaatatgggataaactgtctcaacattttcttttacatgtgaatcccgtcaagtttgaacgtgggagtaatcaattagggggtgtttggcatgtgggaatggaaattatgagattatagtcgag

SEQ ID NO: 469 - DNA, 200 bp, Amaranthus palmeri
tcattcgggtcatcgggttgatttcaggttatgtgtttcaggtcggttcaaaatcgggatttgtgttcacattggcttttacataattatagatccacttttaaatcgggtctaatcgggttcgattataaagtcggatgtctatcgggtcatcgggtatgttttgaacacctctaattaaaacccatcccttccgatct

SEQ ID NO: 470 - DNA, 200 bp, Amaranthus palmeri
agatcggaagggatgggttttaattagaggtgttcaaaacatacccgatgacccgatagacatccgactttataatcgaacccgattagacccgatttaaaagtggatctataattatgtaaaagccaatgtgaacacaaatcccgattttgaaccgacctgaaacacataacctgaaatcaacccgatgacccgaatga

SEQ ID NO: 471 - DNA, 200 bp, Amaranthus palmeri
aattaaaacccatcccttccgatctaacttaacattcatgtacctcgttaaaccacaaaatctgtttctaagcttgtaatttcaacaaaatctaaccaacttaagtcttaagttaaaaaccaagaggaaaagggcggtttcaatcttcaatctcgagtggacgccataactaatggctgatgcagatcatctcacattct

SEQ ID NO: 472 - DNA, 200 bp, Amaranthus palmeri
agaatgtgagatgatctgcatcagccattagttatggcgtccactcgagattgaagattgaaaccgcccttttcctcttggtttttaacttaagacttaagttggttagattttgttgaaattacaagcttagaaacagattttgtggtttaacgaggtacatgaatgttaagttagatcggaagggatgggttttaatt

SEQ ID NO: 473 - DNA, 200 bp, Amaranthus palmeri
gctgatgcagatcatctcacattcttaacatttcaattcactgaatcttgggattttggtgtttaaaaacaagatcatggtaatcctttaaaccttaaattgtaattaaagtcattaaatttgtggttttgatgtattcaacgtttaaagtatttaatttacccaagatcaggtagtgggggattgtgcatttgtgcatc

SEQ ID NO: 474 - DNA, 200 bp, Amaranthus palmeri
gatgcacaaatgcacaatcccccactacctgatcttgggtaaattaaatactttaaacgttgaatacatcaaaaccacaaatttaatgactttaattacaatttaaggtttaaaggattaccatgatcttgtttttaaacaccaaaatcccaagattcagtgaattgaaatgttaagaatgtgagatgatctgcatcagc

SEQ ID NO: 475 - DNA, 200 bp, Amaranthus palmeri
gtgggggattgtgcatttgtgcatcagatcagtacaggattaatgtgcagcaacagttcattcgagtcttagagggtgagcgaggggattgactatataatatagggccgtcttattcttccgtatgaaaaagttaacaagaaatgtatgttaagtctattaataaaataaaaatattactacaaataaagtgcaaataa

SEQ ID NO: 476 - DNA, 200 bp, Amaranthus palmeri
ttatttgcactttatttgtagtaatatttttattttattaatagacttaacatacatttcttgttaactttttcatacggaagaataagacggccctatattatatagtcaatcccctcgctcaccctctaagactcgaatgaactgttgctgcacattaatcctgtactgatctgatgcacaaatgcacaatcccccac

SEQ ID NO: 477 - DNA, 200 bp, Amaranthus palmeri
attactacaaataaagtgcaaataaaagttttacacagggcccctaaatttttcaaaacggctctcagccacacaagtagacagtcatcagccgagtacttcctccgtctaacaaattgtgacagtgaggataaatatagttaattatgtccaaaatttataatataaatataaagatttcgtaggtgaactgtaaataa

SEQ ID NO: 478 - DNA, 200 bp, Amaranthus palmeri
ttatttacagttcacctacgaaatctttatatttatattataaattttggacataattaactatatttatcctcactgtcacaatttgttagacggaggaagtactcggctgatgactgtctacttgtgtggctgagagccgttttgaaaaatttaggggccctgtgtaaaacttttatttgcactttatttgtagtaat

SEQ ID NO: 479 - DNA, 200 bp, Amaranthus palmeri
gatttcgtaggtgaactgtaaataaatcaacccaaaataacaatacaaatttttgtgagagatggtctctttgagagaccatctctagttgggcggctcattatatattttttaaaatattgtaagtaggcattaggaatgatctaagtatacatttaagatattgaaagtaggcattaaggatacgataataagtaagc

SEQ ID NO: 480 - DNA, 200 bp, Amaranthus palmeri
gcttacttattatcgtatccttaatgcctactttcaatatcttaaatgtatacttagatcattcctaatgcctacttacaatattttaaaaaatatataatgagccgcccaactagagatggtctctcaaagagaccatctctcacaaaaatttgtattgttattttgggttgatttatttacagttcacctacgaaatc

SEQ ID NO: 481 - DNA, 200 bp, Amaranthus palmeri
attaaggatacgataataagtaagcactaaggataatgttagtagacattaaaaatatgataaatagacattaatctttaatgggttggacttgagatatatttttcaaagagacgatctctcaagagattagctgaaataccaatgagaacaaatttaacaaacgaaaagagtaataaatatatgaggagttaaaactt

SEQ ID NO: 482 - DNA, 200 bp, Amaranthus palmeri
aagttttaactcctcatatatttattactcttttcgtttgttaaatttgttctcattggtatttcagctaatctcttgagagatcgtctctttgaaaaatatatctcaagtccaacccattaaagattaatgtctatttatcatatttttaatgtctactaacattatccttagtgcttacttattatcgtatccttaat

SEQ ID NO: 483 - DNA, 200 bp, Amaranthus palmeri
ataaatatatgaggagttaaaacttaaaatgcatgtgagaacaaaaatgcaagaaaatgatgaaacatttttataaaggagaattgtagcaaaataaaaagaatgaacaaaagtaaaaggtatttcctctgtttcataatcgttgctagcgttagtgacattttctaacataacatgtcacactaatggagaaagtattt

SEQ ID NO: 484 - DNA, 200 bp, Amaranthus palmeri
aaatactttctccattagtgtgacatgttatgttagaaaatgtcactaacgctagcaacgattatgaaacagaggaaataccttttacttttgttcattctttttattttgctacaattctcctttataaaaatgtttcatcattttcttgcatttttgttctcacatgcattttaagttttaactcctcatatatttat

SEQ ID NO: 485 - DNA, 200 bp, Amaranthus palmeri
tgtcacactaatggagaaagtatttgacaagtctcttagtcaattgaaagcatatttcttaggaaaaagatgagctgagtttgttcagtgatttgatgatgtgatcaaatcattagtgaatcagtgaaaccatactcatgattatatgattacaactttaacaaacaagtaaatattgcatctttggagatatcaatgag

SEQ ID NO: 486 - DNA, 200 bp, Amaranthus palmeri
ctcattgatatctccaaagatgcaatatttacttgtttgttaaagttgtaatcatataatcatgagtatggtttcactgattcactaatgatttgatcacatcatcaaatcactgaacaaactcagctcatctttttcctaagaaatatgctttcaattgactaagagacttgtcaaatactttctccattagtgtgaca

SEQ ID NO: 487 - DNA, 200 bp, Amaranthus palmeri
ttgcatctttggagatatcaatgagtcaattgactaatgaatgttctaaaagactaaacacaaaagattgcaccaactcataacaccccatctatctatctttttaatttagtatcattttttattttgggttattcgtctcatttgtattaataatacatcactttctttgaaccttattcatacattttaaccctttt

SEQ ID NO: 488 - DNA, 200 bp, Amaranthus palmeri
aaaagggttaaaatgtatgaataaggttcaaagaaagtgatgtattattaatacaaatgagacgaataacccaaaataaaaaatgatactaaattaaaaagatagatagatggggtgttatgagttggtgcaatcttttgtgtttagtcttttagaacattcattagtcaattgactcattgatatctccaaagatgcaa

SEQ ID NO: 489 - DNA, 200 bp, Amaranthus palmeri
cttattcatacattttaaccctttttttaatatcatccacgcaattcaatctcttttggcttattaccaataagactcaaaaaaatgtacgaccttaacaaagaaatttattgtcgattaaatcatcatcatcatcatacccagtgtatctcgctcattattgtcgattaaatcttaatagaaaatattatgtacaactt

SEQ ID NO: 490 - DNA, 200 bp, Amaranthus palmeri
aagttgtacataatattttctattaagatttaatcgacaataatgagcgagatacactgggtatgatgatgatgatgatttaatcgacaataaatttctttgttaaggtcgtacatttttttgagtcttattggtaataagccaaaagagattgaattgcgtggatgatattaaaaaaagggttaaaatgtatgaataag

SEQ ID NO: 491 - DNA, 200 bp, Amaranthus palmeri
taatagaaaatattatgtacaacttcacataaataataaattagaaatactcataatttagtaagtcattttactatacttcatataaatataaagaattttaataaaattttccatcacctcttattatcggaaattctctaacctgcacccgagtcaaaaaattaaaaaaataataaattgcaaaagcaaaaaccttt

SEQ ID NO: 492 - DNA, 200 bp, Amaranthus palmeri
aaaggtttttgcttttgcaatttattatttttttaattttttgactcgggtgcaggttagagaatttccgataataagaggtgatggaaaattttattaaaattctttatatttatatgaagtatagtaaaatgacttactaaattatgagtatttctaatttattatttatgtgaagttgtacataatattttctatta

SEQ ID NO: 493 - DNA, 200 bp, Amaranthus palmeri
ataaattgcaaaagcaaaaacctttatcaaccacaagactgaaaaaatagtaattaatttgtcaccaaagatatattatatgaataataactaattagtgttgttttttaggatatatgcatttaaaaaatgttaccttatgattagcaaaatcaagcaacaaaactatatgatgatttaagtttgtctcatttgagacc

SEQ ID NO: 494 - DNA, 200 bp, Amaranthus palmeri
ggtctcaaatgagacaaacttaaatcatcatatagttttgttgcttgattttgctaatcataaggtaacattttttaaatgcatatatcctaaaaaacaacactaattagttattattcatataatatatctttggtgacaaattaattactattttttcagtcttgtggttgataaaggtttttgcttttgcaatttat

SEQ ID NO: 495 - DNA, 200 bp, Amaranthus palmeri
atttaagtttgtctcatttgagaccatccaacaagaagtcatgtggaaaatcctaaactatagtgattagaaagactagtataccaaatctttgaataagatgacaaaagatattgattaaactaatcttaattagctatatccaaaatatttggcgatttatggcgtttgataaatgactgatagctggtagttgataa

SEQ ID NO: 496 - DNA, 200 bp, Amaranthus palmeri
ttatcaactaccagctatcagtcatttatcaaacgccataaatcgccaaatattttggatatagctaattaagattagtttaatcaatatcttttgtcatcttattcaaagatttggtatactagtctttctaatcactatagtttaggattttccacatgacttcttgttggatggtctcaaatgagacaaacttaaat

SEQ ID NO: 497 - DNA, 200 bp, Amaranthus palmeri
atgactgatagctggtagttgataactgattatagtgactgatttgatcagttgattttattaactgtttcaaccagttaattcaccaaagactagcattagctggtttgaccacccaacccttatttatatcaaaataagctaaaattacccaataagctaatttgtcaaatacccgtgtatattatgtaagtttgaga

SEQ ID NO: 498 - DNA, 200 bp, Amaranthus palmeri
tctcaaacttacataatatacacgggtatttgacaaattagcttattgggtaattttagcttattttgatataaataagggttgggtggtcaaaccagctaatgctagtctttggtgaattaactggttgaaacagttaataaaatcaactgatcaaatcagtcactataatcagttatcaactaccagctatcagtcat

SEQ ID NO: 499 - DNA, 200 bp, Amaranthus palmeri
ccgtgtatattatgtaagtttgagagtaaaaatatttttttttagaaaaaatattaatttaacttttacttatcttgcctttcctcggcctatcgattcagtaataaaaaaaattctctcaatataatgttatagaaatatactctctctgttcttttaagtttgttcacattactctaacgggcagtttcatatgtttg

SEQ ID NO: 500 - DNA, 200 bp, Amaranthus palmeri
caaacatatgaaactgcccgttagagtaatgtgaacaaacttaaaagaacagagagagtatatttctataacattatattgagagaattttttttattactgaatcgataggccgaggaaaggcaagataagtaaaagttaaattaatattttttctaaaaaaaaatatttttactctcaaacttacataatatacacgg

SEQ ID NO: 501 - DNA, 200 bp, Amaranthus rudis
aagtatgtacaagttgttaggtcatcactcaaaagtgatgtgtcacatttcatcatatgagcaaaaagtatttggttttagggataagcgactaaacaaatagatctatgtgaagattaacattttggaatattgaaactctatttgggaagtgattggagttggtagatagaatggaaaaacttaagatggactttatg

SEQ ID NO: 502 - DNA, 200 bp, Amaranthus rudis
cataaagtccatcttaagtttttccattctatctaccaactccaatcacttcccaaatagagtttcaatattccaaaatgttaatcttcacatagatctatttgtttagtcgcttatccctaaaaccaaatactttttgctcatatgatgaaatgtgacacatcacttttgagtgatgacctaacaacttgtacatactt

SEQ ID NO: 503 - DNA, 200 bp, Amaranthus rudis
ggaaaaacttaagatggactttatgtaggagatcacgtggattaatggagagaccaggccattcaaaacaaataagaaattatgcacattattgtatacatgcaaattaagaagagaaacaaacttggtatcatgatgggtgagtagtttgcctatgacgttgtagaggtgtgtggataaatgattagaacatgagctat

SEQ ID NO: 504 - DNA, 200 bp, Amaranthus rudis
atagctcatgttctaatcatttatccacacacctctacaacgtcataggcaaactactcacccatcatgataccaagtttgtttctcttcttaatttgcatgtatacaataatgtgcataatttcttatttgttttgaatggcctggtctctccattaatccacgtgatctcctacataaagtccatcttaagtttttcc

SEQ ID NO: 505 - DNA, 200 bp, Amaranthus rudis
gataaatgattagaacatgagctatgaatggaagagaaatattaatggttggtgcatatgcgcctcaagtgaaggcaaaggaagcaacaccaacaatgtcaaagtcttatttttaggtaatatgaaaaacaaaggaagcaatcaaaagaaatttctcaggcgagttgatgcaaattatcccaacattaagaaaattttgt

SEQ ID NO: 506 - DNA, 200 bp, Amaranthus rudis
acaaaattttcttaatgttgggataatttgcatcaactcgcctgagaaatttcttttgattgcttcctttgtttttcatattacctaaaaataagactttgacattgttggtgttgcttcctttgccttcacttgaggcgcatatgcaccaaccattaatatttctcttccattcatagctcatgttctaatcatttatc

SEQ ID NO: 507 - DNA, 200 bp, Amaranthus rudis
tatcccaacattaagaaaattttgtatactagcgaacatgtagccatccatcacaaacacgtagtcctagatcttcatatgtgatcaacctcgtgcaagaatgaacttcaaggacaaagaaaaatcaaatgatagaacccaaaataagaggatacgaatttttcatttgattagacaaatgaggaagatccaaatccaac

SEQ ID NO: 508 - DNA, 200 bp, Amaranthus rudis
gttggatttggatcttcctcatttgtctaatcaaatgaaaaattcgtatcctcttattttgggttctatcatttgatttttctttgtccttgaagttcattcttgcacgaggttgatcacatatgaagatctaggactacgtgtttgtgatggatggctacatgttcgctagtatacaaaattttcttaatgttgggata

SEQ ID NO: 509 - DNA, 200 bp, Amaranthus rudis
caaatgaggaagatccaaatccaacttggacaaagatgaagaatgttatcacccgcacaactaggggaattcaaggttaagcggattgtggtatgaggtaagaaagaatacaatataggggaattaggaagtaaaggaataagaaaaaaaagaatgatatatagctttaggaaaatctaggagtgaggagaatatagcaa

SEQ ID NO: 510 - DNA, 200 bp, Amaranthus rudis
ttgctatattctcctcactcctagattttcctaaagctatatatcattcttttttttcttattcctttacttcctaattcccctatattgtattctttcttacctcataccacaatccgcttaaccttgaattcccctagttgtgcgggtgataacattcttcatctttgtccaagttggatttggatcttcctcatttg

SEQ ID NO: 511 - DNA, 200 bp, Amaranthus rudis
tctaggagtgaggagaatatagcaaaatatgaggaagttaaaaccaagacgaagcaagcgatatgtgagacaaagttaaaagataagagatatacaataagctgactcaagagaagaggataatgatctttgtagggtagcctaaaggagacaaatgattataaaagatactagttgaatgaactatgaagtgtgtcttg

SEQ ID NO: 512 - DNA, 200 bp, Amaranthus rudis
caagacacacttcatagttcattcaactagtatcttttataatcatttgtctcctttaggctaccctacaaagatcattatcctcttctcttgagtcagcttattgtatatctcttatcttttaactttgtctcacatatcgcttgcttcgtcttggttttaacttcctcatattttgctatattctcctcactcctaga

SEQ ID NO: 513 - DNA, 200 bp, Amaranthus rudis
tgaatgaactatgaagtgtgtcttggataaataacaaaataatattctccaagatgaatagatatacgataaatggaaggagtttttgacgagttgtgcaatggatgtcaaggggcacgatagtatacatctagaagaaattctgaaaaggtgcttttcttagaatgtaaattgtgagaaaaaggaagaaggcgattatc

SEQ ID NO: 514 - DNA, 200 bp, Amaranthus rudis
gataatcgccttcttcctttttctcacaatttacattctaagaaaagcaccttttcagaatttcttctagatgtatactatcgtgccccttgacatccattgcacaactcgtcaaaaactccttccatttatcgtatatctattcatcttggagaatattattttgttatttatccaagacacacttcatagttcattca

SEQ ID NO: 515 - DNA, 200 bp, Amaranthus rudis
gagaaaaaggaagaaggcgattatcagtaaatcaattgtctttgttcacagaatgtgacaccaacatgttggatgggggagagaagttttctttgttaacgaatctttcggttatgtatggaagtatgttattttatgagacatcttgttcaagagctcatcattaatatagaggagtagaggtgttcaacgggatgggt

SEQ ID NO: 516 - DNA, 200 bp, Amaranthus rudis
acccatcccgttgaacacctctactcctctatattaatgatgagctcttgaacaagatgtctcataaaataacatacttccatacataaccgaaagattcgttaacaaagaaaacttctctcccccatccaacatgttggtgtcacattctgtgaacaaagacaattgatttactgataatcgccttcttcctttttctc

SEQ ID NO: 517 - DNA, 200 bp, Amaranthus rudis
agtagaggtgttcaacgggatgggtcggggcaaaatttaaattggtcgggccggggcgggtcatgtctaagaggagcaacaacataaataataaaatataccatcgtatggacatatagtttagagatagattcaaaaatttttatatcttcaaatatgaatgtgagaaccgacttctcatactttattttacttacagg

SEQ ID NO: 518 - DNA, 200 bp, Amaranthus rudis
cctgtaagtaaaataaagtatgagaagtcggttctcacattcatatttgaagatataaaaatttttgaatctatctctaaactatatgtccatacgatggtatattttattatttatgttgttgctcctcttagacatgacccgccccggcccgaccaatttaaattttgccccgacccatcccgttgaacacctctact

SEQ ID NO: 519 - DNA, 200 bp, Amaranthus rudis
tctcatactttattttacttacaggtttggctggtctatccacagcaaagtatttagctgatgcaggtcacaaacccatattgctggaagcacgagatgttttaggaggaaaggtgtgtgctatacttttcttgtagcttatgaaacaactccattgtgcttactctctaattagtttacttcagactatcagatgattt

SEQ ID NO: 520 - DNA, 200 bp, Amaranthus rudis
aaatcatctgatagtctgaagtaaactaattagagagtaagcacaatggagttgtttcataagctacaagaaaagtatagcacacacctttcctcctaaaacatctcgtgcttccagcaatatgggtttgtgacctgcatcagctaaatactttgctgtggatagaccagccaaacctgtaagtaaaataaagtatgaga

SEQ ID NO: 521 - DNA, 200 bp, Amaranthus rudis
tttacttcagactatcagatgatttttgaactttttcctccctctgttcggctgtataattatatatgagaaacatgtttaaaaatgggtgcattaacatatatgaagttttttttatcaaggcgagattttgtcatccaaaaactttacttctgaatctgaacatgctgtatgatcctgtttctttatcttcatttgtt

SEQ ID NO: 522 - DNA, 200 bp, Amaranthus rudis
aacaaatgaagataaagaaacaggatcatacagcatgttcagattcagaagtaaagtttttggatgacaaaatctcgccttgataaaaaaaacttcatatatgttaatgcacccatttttaaacatgtttctcatatataattatacagccgaacagagggaggaaaaagttcaaaaatcatctgatagtctgaagtaaa

SEQ ID NO: 523 - DNA, 200 bp, Amaranthus rudis
tcctgtttctttatcttcatttgttgggattttcttgaggctcatgactactttcagttattatagttacccatcctgcataaatccgagtttacagttatagtaatgaaaataaataggctaattatattctcgtcggtcatcacagtatgatgaatcttgggctaatatgaagatgaggtaggaagaagaatttgtgt

SEQ ID NO: 524 - DNA, 200 bp, Amaranthus rudis
acacaaattcttcttcctacctcatcttcatattagcccaagattcatcatactgtgatgaccgacgagaatataattagcctatttattttcattactataactgtaaactcggatttatgcaggatgggtaactataataactgaaagtagtcatgagcctcaagaaaatcccaacaaatgaagataaagaaacagga

SEQ ID NO: 525 - DNA, 200 bp, Amaranthus rudis
atgaggtaggaagaagaatttgtgttagtatgataatatgtgcccgccctaagcaagtgcaagccttgcctacgcctagggccccccaaaaattttagttttcaactagtgctaacgttcgaacttttctatatatatacaatagtttaggggcccaaataatctttcgccccgggcccctaaaaacctagggtcggcta

SEQ ID NO: 526 - DNA, 200 bp, Amaranthus rudis
tagccgaccctaggtttttaggggcccggggcgaaagattatttgggcccctaaactattgtatatatatagaaaagttcgaacgttagcactagttgaaaactaaaatttttggggggccctaggcgtaggcaaggcttgcacttgcttagggcgggcacatattatcatactaacacaaattcttcttcctacctcat

SEQ ID NO: 527 - DNA, 200 bp, Amaranthus rudis
gcccctaaaaacctagggtcggctagtgccaagagaaatattgttgtgcaaagtttcttggtattttttcttgtgcttacaattcttgctccacagattgcagcgtggaaggatgaggatggtgactggtatgagactgggctacatatattctgtgagtgatcttttaattttctgcttagttgggtagttacccgtgt

SEQ ID NO: 528 - DNA, 200 bp, Amaranthus rudis
acacgggtaactacccaactaagcagaaaattaaaagatcactcacagaatatatgtagcccagtctcataccagtcaccatcctcatccttccacgctgcaatctgtggagcaagaattgtaagcacaagaaaaaataccaagaaactttgcacaacaatatttctcttggcactagccgaccctaggtttttaggggc

SEQ ID NO: 529 - DNA, 200 bp, Amaranthus rudis
tgcttagttgggtagttacccgtgtacttattatgtgcactctagtcatgtttattggaaaaatttactgcatatttatcagtccgatgtactgaacatcttcatattttcttgaagttggggcatatccaaatatccaaaatctatttggagaacttggtataaatgaccgattgcaatggaaggagcactctatgatt

SEQ ID NO: 530 - DNA, 200 bp, Amaranthus rudis
aatcatagagtgctccttccattgcaatcggtcatttataccaagttctccaaatagattttggatatttggatatgccccaacttcaagaaaatatgaagatgttcagtacatcggactgataaatatgcagtaaatttttccaataaacatgactagagtgcacataataagtacacgggtaactacccaactaagca

SEQ ID NO: 531 - DNA, 200 bp, Amaranthus rudis
gcaatggaaggagcactctatgatttttgcaatgcctagcaaacccggtgaattcagtcgctttgattttcccgaagtcctgcctgcaccattaaatggttagtatatcggtgatggtttttgttggctgccaaattacttgatgcaatgcattaccttgtaaaatactccttccgtccccctgattttgccccatatac

SEQ ID NO: 532 - DNA, 200 bp, Amaranthus rudis
gtatatggggcaaaatcagggggacggaaggagtattttacaaggtaatgcattgcatcaagtaatttggcagccaacaaaaaccatcaccgatatactaaccatttaatggtgcaggcaggacttcgggaaaatcaaagcgactgaattcaccgggtttgctaggcattgcaaaaatcatagagtgctccttccattgc

SEQ ID NO: 533 - DNA, 200 bp, Amaranthus rudis
gtccccctgattttgccccatatactattttagtccgttcaattgaatttgcccattattatttttggacgtggttccacctataatacttgctataacctacaatttatttctctttcctacatcaaaaactatgattatcccgctaaaggacatggccccacttacaacacctcactaaaatacccactcacccgctt

SEQ ID NO: 534 - DNA, 200 bp, Amaranthus rudis
aagcgggtgagtgggtattttagtgaggtgttgtaagtggggccatgtcctttagcgggataatcatagtttttgatgtaggaaagagaaataaattgtaggttatagcaagtattataggtggaaccacgtccaaaaataataatgggcaaattcaattgaacggactaaaatagtatatggggcaaaatcagggggac

SEQ ID NO: 535 - DNA, 200 bp, Amaranthus rudis
cactaaaatacccactcacccgcttttcttaatcattgtaccatccgcccgaggagcaatctcggggggacagcggagtactactttagtgtttatgtgatgaaataggtacctgcatcaatatctcatgtcctgtggatacctagaaatgaatgaaaattatcattccgtattatcctgctttagaagcttgtaatatc

SEQ ID NO: 536 - DNA, 200 bp, Amaranthus rudis
gatattacaagcttctaaagcaggataatacggaatgataattttcattcatttctaggtatccacaggacatgagatattgatgcaggtacctatttcatcacataaacactaaagtagtactccgctgtccccccgagattgctcctcgggcggatggtacaatgattaagaaaagcgggtgagtgggtattttagtg

SEQ ID NO: 537 - DNA, 200 bp, Amaranthus rudis
tcctgctttagaagcttgtaatatcactgaactttgttattctaatgtcttaacatgaaaagaatctgcatcttggtctgtttggactttggtactcctaaaccctaacgagtcgggctgatttatatctttgatgctttttgattgtgtttggcaggcatatgggcaatcctaaggaataatgaaatgctaacctggcc

SEQ ID NO: 538 - DNA, 200 bp, Amaranthus rudis
ggccaggttagcatttcattattccttaggattgcccatatgcctgccaaacacaatcaaaaagcatcaaagatataaatcagcccgactcgttagggtttaggagtaccaaagtccaaacagaccaagatgcagattcttttcatgttaagacattagaataacaaagttcagtgatattacaagcttctaaagcagga

SEQ ID NO: 539 - DNA, 200 bp, Amaranthus rudis
ggaataatgaaatgctaacctggccagaaaaaatcaagtttgccattggcttgttgcctgctatggctggtggacagtcatatgttgaagcacaagatggtttgagtgtccaagagtggatgagaaagcaagtaggagcagactttcgtttcagattttcctcattttgttaatctcttctgattctgtcgattacgatg

SEQ ID NO: 540 - DNA, 200 bp, Amaranthus rudis
catcgtaatcgacagaatcagaagagattaacaaaatgaggaaaatctgaaacgaaagtctgctcctacttgctttctcatccactcttggacactcaaaccatcttgtgcttcaacatatgactgtccaccagccatagcaggcaacaagccaatggcaaacttgattttttctggccaggttagcatttcattattcc

SEQ ID NO: 541 - DNA, 200 bp, Amaranthus rudis
tcttctgattctgtcgattacgatgattctagctgtaaactttgactttgttgggacttcaatgctgaaattctgtttgcgcataaatgcagggagtacctgatcgtgtaactgatgaagtatttattgccatgtcaaaggcactgaacttcataaatcccgatgaactttcaatgcagtgcatcttgattgctctgaac

SEQ ID NO: 542 - DNA, 200 bp, Amaranthus rudis
gttcagagcaatcaagatgcactgcattgaaagttcatcgggatttatgaagttcagtgcctttgacatggcaataaatacttcatcagttacacgatcaggtactccctgcatttatgcgcaaacagaatttcagcattgaagtcccaacaaagtcaaagtttacagctagaatcatcgtaatcgacagaatcagaaga

SEQ ID NO: 543 - DNA, 200 bp, Amaranthus rudis
gcagtgcatcttgattgctctgaaccgattcctgcaggcatgagtgcctttcaatttctgctttaaattttttgttttgtacgacacttcttattgcttgtttttgtgactattctcgagtaaatttgggatataaaatgaccgtgctgttttccataaactgaccttgggtaatgtatatcaacaggagaaacatggtt

SEQ ID NO: 544 - DNA, 200 bp, Amaranthus rudis
aaccatgtttctcctgttgatatacattacccaaggtcagtttatggaaaacagcacggtcattttatatcccaaatttactcgagaatagtcacaaaaacaagcaataagaagtgtcgtacaaaacaaaaaatttaaagcagaaattgaaaggcactcatgcctgcaggaatcggttcagagcaatcaagatgcactgc

SEQ ID NO: 545 - DNA, 200 bp, Amaranthus rudis
gtatatcaacaggagaaacatggttctaagatggccttccttgacggaaaccctccagagaggctgtgcatgcctattgttgagcacattgagtcactaggtggtgaagttaaacttaactctcgtatacaaaagattgagttggatcagagtggaagtgttaagagttttttgctaactaatgggagggaaataagagg

SEQ ID NO: 546 - DNA, 200 bp, Amaranthus rudis
cctcttatttccctcccattagttagcaaaaaactcttaacacttccactctgatccaactcaatcttttgtatacgagagttaagtttaacttcaccacctagtgactcaatgtgctcaacaataggcatgcacagcctctctggagggtttccgtcaaggaaggccatcttagaaccatgtttctcctgttgatatac

SEQ ID NO: 547 - DNA, 200 bp, Amaranthus rudis
taactaatgggagggaaataagaggagatgcctatgtatttgccaccccaggttttcttctctcccttttttgccataaggtctctatcaaactccgtaaaagctacatagtaaagaaaatgaagattccattgcagatatggacacaccgtatagcttaactagttttgatcttgtgcaaagcacttgtgtttccaaat

SEQ ID NO: 548 - DNA, 200 bp, Amaranthus rudis
atttggaaacacaagtgctttgcacaagatcaaaactagttaagctatacggtgtgtccatatctgcaatggaatcttcattttctttactatgtagcttttacggagtttgatagagaccttatggcaaaaaagggagagaagaaaacctggggtggcaaatacataggcatctcctcttatttccctcccattagtta

SEQ ID NO: 549 - DNA, 200 bp, Amaranthus rudis
agttcatattttgtatatatgcaggattatgatctgctgagttctcgagcacaaagagaattggcggcgacaagcaatgtataaccctggattgcttcgacatccgccatcgattttcattcgggatcatctgatcggtcatcgaataatgatcagctgtaaacacaaaattatgggggttgcatactggtgttcttcaa

SEQ ID NO: 550 - DNA, 200 bp, Amaranthus rudis
ttgaagaacaccagtatgcaacccccataattttgtgtttacagctgatcattattcgatgaccgatcagatgatcccgaatgaaaatcgatggcggatgtcgaagcaatccagggttatacattgcttgtcgccgccaattctctttgtgctcgagaactcagcagatcataatcctgcatatatacaaaatatgaact

SEQ ID NO: 551 - DNA, 200 bp, Amaranthus rudis
ggggttgcatactggtgttcttcaagttcttaatgtataaattctccagaaagaagatttatttgtaatgatatatcaattaaatttatgttgtgatagaaatatgtatagcttacttctagggaaaattatgtttgtacaccagttaacttgattgaaatgtgaagaaagtatcaactttgtcacttgatttacttgta

SEQ ID NO: 552 - DNA, 200 bp, Amaranthus rudis
tacaagtaaatcaagtgacaaagttgatactttcttcacatttcaatcaagttaactggtgtacaaacataattttccctagaagtaagctatacatatttctatcacaacataaatttaattgatatatcattacaaataaatcttctttctggagaatttatacattaagaacttgaagaacaccagtatgcaacccc

SEQ ID NO: 553 - DNA, 200 bp, Amaranthus rudis
caattcgaaccaaaaataacccaagcgaaagtgactcaacccgaaacctaccctgatctaattgtaatgatagctttgaaatttttatcgttttagttaacaagttctgttgacgaatcttctttaaatttttacaagttaatataaatctcgaaagttcctataaacttattttacagattgtcaagattagttgtata

SEQ ID NO: 554 - DNA, 200 bp, Amaranthus rudis
tatacaactaatcttgacaatctgtaaaataagtttataggaactttcgagatttatattaacttgtaaaaatttaaagaagattcgtcaacagaacttgttaactaaaacgataaaaatttcaaagctatcattacaattagatcagggtaggtttcgggttgagtcactttcgcttgggttatttttggttcgaattg

SEQ ID NO: 555 - DNA, 200 bp, Amaranthus rudis
cagggagattagcgaatcatgtgacactgtgtctgatataatttttgaatttcattgtcagttgacatcttgaagctgttactacctgatacttggaaggaaatctcatacttcaaaaagcttgagaaattagtgggcgttcctgtgattaatgttcacatatggttagttgattcttcattctatattaaatatactcg

SEQ ID NO: 556 - DNA, 200 bp, Amaranthus rudis
cgagtatatttaatatagaatgaagaatcaactaaccatatgtgaacattaatcacaggaacgcccactaatttctcaagctttttgaagtatgagatttccttccaagtatcaggtagtaacagcttcaagatgtcaactgacaatgaaattcaaaaattatatcagacacagtgtcacatgattcgctaatctccctg

SEQ ID NO: 557 - DNA, 200 bp, Amaranthus rudis
cttcattctatattaaatatactcgttagattttatacccattttccgtctcaggaaaaatactattcgctgcaatagagaacgataaaatgtggattatttaatgcgttgctttactccggggctaatggtataataacgcttcatgcaggtttgacagaaaattaaagaatacatatgaccatctactcttcagcagg

SEQ ID NO: 558 - DNA, 200 bp, Amaranthus rudis
cctgctgaagagtagatggtcatatgtattctttaattttctgtcaaacctgcatgaagcgttattataccattagccccggagtaaagcaacgcattaaataatccacattttatcgttctctattgcagcgaatagtatttttcctgagacggaaaatgggtataaaatctaacgagtatatttaatatagaatgaag

SEQ ID NO: 559 - DNA, 200 bp, Amaranthus rudis
atatgaccatctactcttcagcaggttgtatttcgtttcttttatcatcctatttctctttcgtaactctcaaataatctcgttcctccccttccctccttcacttcaacacttgtttcaattcttcattttcggccgtagtcaaatttgatgaacatttgacaagagttgcattataactaatatgaacattggagaag

SEQ ID NO: 560 - DNA, 200 bp, Amaranthus rudis
cttctccaatgttcatattagttataatgcaactcttgtcaaatgttcatcaaatttgactacggccgaaaatgaagaattgaaacaagtgttgaagtgaaggagggaaggggaggaacgagattatttgagagttacgaaagagaaataggatgataaaagaaacgaaatacaacctgctgaagagtagatggtcatat

SEQ ID NO: 561 - DNA, 200 bp, Amaranthus rudis
ataactaatatgaacattggagaaggagcaacaatcatcatctatgaagtataagctaagattcctttgaagaaggtgaaagttaagtgcgaattttctttccattgggaaataagtcttttgattaacgtcttgaatagatgaaggatgcaagtttttggaatgaagagaaactttttatgtgatctagttgcgagtcg

SEQ ID NO: 562 - DNA, 200 bp, Amaranthus rudis
cgactcgcaactagatcacataaaaagtttctcttcattccaaaaacttgcatccttcatctattcaagacgttaatcaaaagacttatttcccaatggaaagaaaattcgcacttaactttcaccttcttcaaaggaatcttagcttatacttcatagatgatgattgttgctccttctccaatgttcatattagttat

SEQ ID NO: 563 - DNA, 200 bp, Amaranthus rudis
ttttatgtgatctagttgcgagtcgatggtgccttgaatttcttcaaaattaaacatttttgttaacgttcgctttattgttgcgctttcatgtccttttcctatagttgtatatggcttctcattctcaacttaggcttacctcaatgcctaaacctttacaaaacacatcatataagaatgagagtgttgaattgttg

SEQ ID NO: 564 - DNA, 200 bp, Amaranthus rudis
caacaattcaacactctcattcttatatgatgtgttttgtaaaggtttaggcattgaggtaagcctaagttgagaatgagaagccatatacaactataggaaaaggacatgaaagcgcaacaataaagcgaacgttaacaaaaatgtttaattttgaagaaattcaaggcaccatcgactcgcaactagatcacataaaa

SEQ ID NO: 565 - DNA, 200 bp, Amaranthus rudis
taagaatgagagtgttgaattgttgatatttacctctccatctcagcacaagtgtctcctttacttttgcactaaattttaggaacatgtaagttaatggatagaaattaaagttagggaatcttgtagggctcaaacaaatgagaactgcaaataactttctaaatatagaaatgggtcacttgtggtgacttgatcct

SEQ ID NO: 566 - DNA, 200 bp, Amaranthus rudis
aggatcaagtcaccacaagtgacccatttctatatttagaaagttatttgcagttctcatttgtttgagccctacaagattccctaactttaatttctatccattaacttacatgttcctaaaatttagtgcaaaagtaaaggagacacttgtgctgagatggagaggtaaatatcaacaattcaacactctcattctta

SEQ ID NO: 567 - DNA, 200 bp, Amaranthus rudis
gggtcacttgtggtgacttgatcctatatgaaaatctgacacttgtgctgagatggagcaagtattatacttatgaaaacataatacttgaggtagatatacctttggtaggaactaggaaccatagtgcaaaaatgtggtaacggttgcaatcgtggtcacgacatgcgattatcataacgcctaatatgagccaaaag

SEQ ID NO: 568 - DNA, 200 bp, Amaranthus rudis
cttttggctcatattaggcgttatgataatcgcatgtcgtgaccacgattgcaaccgttaccacatttttgcactatggttcctagttcctaccaaaggtatatctacctcaagtattatgttttcataagtataatacttgctccatctcagcacaagtgtcagattttcatataggatcaagtcaccacaagtgaccc

SEQ ID NO: 569 - DNA, 200 bp, Amaranthus rudis
cataacgcctaatatgagccaaaagcgtgagatattccttgtaacggcccaaaacacggttttttttacacctttacatcgcgagaaatttcggtttgtttttttagaatctttaaaatacggccgatgctatgcgatgcgatgcggccttatttttgcactatggtagggacaaaacatttgcggatgatggatgcaca

SEQ ID NO: 570 - DNA, 200 bp, Amaranthus rudis
tgtgcatccatcatccgcaaatgttttgtccctaccatagtgcaaaaataaggccgcatcgcatcgcatagcatcggccgtattttaaagattctaaaaaaacaaaccgaaatttctcgcgatgtaaaggtgtaaaaaaaaccgtgttttgggccgttacaaggaatatctcacgcttttggctcatattaggcgttatg

SEQ ID NO: 571 - DNA, 200 bp, Amaranthus rudis
aacatttgcggatgatggatgcacacattggttaccatgtctggtccccttttcacttatacagatcccaagggcatatgtatgttactgattcaaagacttcaatctctaggattaaatgtagaaaccatataaaaatggatctttaaaatacttttatctttgttatttcaggagtcctcttttgagtgtctatgctg

SEQ ID NO: 572 - DNA, 200 bp, Amaranthus rudis
cagcatagacactcaaaagaggactcctgaaataacaaagataaaagtattttaaagatccatttttatatggtttctacatttaatcctagagattgaagtctttgaatcagtaacatacatatgcccttgggatctgtataagtgaaaaggggaccagacatggtaaccaatgtgtgcatccatcatccgcaaatgtt

SEQ ID NO: 573 - DNA, 200 bp, Amaranthus rudis
agtcctcttttgagtgtctatgctgatatgtcggagacatgcaaggtgatcatattcccattcttttatttccgacttatatgttctagttctccatttgtctctttttcgcgcatataatttcgaatgttagccactccccattactccttctatttctgctaacaccgggattttaactatgagggtcctcagaattg

SEQ ID NO: 574 - DNA, 200 bp, Amaranthus rudis
caattctgaggaccctcatagttaaaatcccggtgttagcagaaatagaaggagtaatggggagtggctaacattcgaaattatatgcgcgaaaaagagacaaatggagaactagaacatataagtcggaaataaaagaatgggaatatgatcaccttgcatgtctccgacatatcagcatagacactcaaaagaggact

SEQ ID NO: 575 - DNA, 200 bp, Amaranthus rudis
ttaactatgagggtcctcagaattgattataaaaattcgacaaaaacaaaaaaaaagaaataaaattgatgggggccataacaattttactcaagatattcaacatttattttacaatttttcttaagaaattcagtacatctacactcccgagccactgcatatgtgcgccacggcttgctgtttaagaaacctttctt

SEQ ID NO: 576 - DNA, 200 bp, Amaranthus rudis
aagaaaggtttcttaaacagcaagccgtggcgcacatatgcagtggctcgggagtgtagatgtactgaatttcttaagaaaaattgtaaaataaatgttgaatatcttgagtaaaattgttatggcccccatcaattttatttctttttttttgtttttgtcgaatttttataatcaattctgaggaccctcatagttaa

SEQ ID NO: 577 - DNA, 200 bp, Amaranthus rudis
ctcaaaattgttgaaaaatagcccaagaccgaccataattcttttttttttgatttgcgattcgcagggagattagcgaatcatgtgacactgtgtctgatataatttttgaatttcattgtcagttgacatcttgaagctgttactacctgatacttggaaggaaatctcatacttcaaaaagcttgagaaattagtgg

SEQ ID NO: 578 - DNA, 200 bp, Amaranthus rudis
ccactaatttctcaagctttttgaagtatgagatttccttccaagtatcaggtagtaacagcttcaagatgtcaactgacaatgaaattcaaaaattatatcagacacagtgtcacatgattcgctaatctccctgcgaatcgcaaatcaaaaaaaaaagaattatggtcggtcttgggctatttttcaacaattttgag

SEQ ID NO: 579 - DNA, 200 bp, Amaranthus rudis
ttcaaaaagcttgagaaattagtgggcgttcctgtgattaatgttcacatatggttagttgattcttcattctatattaaatatactcgttagattttatacccattttccgtctcaggaaaaatactattcgctgcaatagagaacgataaaatgtggattatttaatgcgttgctttactccggggctaatggtataa

SEQ ID NO: 580 - DNA, 200 bp, Amaranthus rudis
ttataccattagccccggagtaaagcaacgcattaaataatccacattttatcgttctctattgcagcgaatagtatttttcctgagacggaaaatgggtataaaatctaacgagtatatttaatatagaatgaagaatcaactaaccatatgtgaacattaatcacaggaacgcccactaatttctcaagctttttgaa

SEQ ID NO: 581 - DNA, 200 bp, Amaranthus rudis
ctttactccggggctaatggtataataacgcttcatgcaggtttgacagaaaattaaagaatacatatgaccatctactcttcagcaggttgtatttcgtttcttttatcatcctatttctctttcgtaactctcaaataatctcgttcctccccttccctccttcacttcaacacttgtttcaattcttcattttcggc

SEQ ID NO: 582 - DNA, 200 bp, Amaranthus rudis
gccgaaaatgaagaattgaaacaagtgttgaagtgaaggagggaaggggaggaacgagattatttgagagttacgaaagagaaataggatgataaaagaaacgaaatacaacctgctgaagagtagatggtcatatgtattctttaattttctgtcaaacctgcatgaagcgttattataccattagccccggagtaaag

SEQ ID NO: 583 - DNA, 200 bp, Amaranthus rudis
cttgtttcaattcttcattttcggccgtagtcaaatttgatgaacatttgacaagagttgcattataactaatatgaacattggagaaggagcaacaatcatcatctatgaagtataagctaagattcctttgaagaaggtgaaagttaagtgcgaattttctttccattgggaaataagtcttttgattaacgtcttga

SEQ ID NO: 584 - DNA, 200 bp, Amaranthus rudis
tcaagacgttaatcaaaagacttatttcccaatggaaagaaaattcgcacttaactttcaccttcttcaaaggaatcttagcttatacttcatagatgatgattgttgctccttctccaatgttcatattagttataatgcaactcttgtcaaatgttcatcaaatttgactacggccgaaaatgaagaattgaaacaag

SEQ ID NO: 585 - DNA, 200 bp, Amaranthus rudis
ataagtcttttgattaacgtcttgaatagatgaaggatgcaagtttttggaatgaagagaaactttttatgtgatctagttgcgagtcgatggtgccttgaatttcttcaaaattaaacatttttgttaatgttcgctttattgttgcgctttcatgtccttttcctatagttgtatatggcttctcattctcaacttag

SEQ ID NO: 586 - DNA, 200 bp, Amaranthus rudis
ctaagttgagaatgagaagccatatacaactataggaaaaggacatgaaagcgcaacaataaagcgaacattaacaaaaatgtttaattttgaagaaattcaaggcaccatcgactcgcaactagatcacataaaaagtttctcttcattccaaaaacttgcatccttcatctattcaagacgttaatcaaaagacttat

SEQ ID NO: 587 - DNA, 200 bp, Amaranthus rudis
atatggcttctcattctcaacttaggcttacctcaatgcctaaacctttacaaaacacatcatataagaatgagagtgttgaattgttgatatttacctctccatctcagcacaagtttcctttacttttgcacaaatcttaggaatgtgtaagttggtgaatagaaattactgttagggaatcttgtggggctcaaaca

SEQ ID NO: 588 - DNA, 200 bp, Amaranthus rudis
tgtttgagccccacaagattccctaacagtaatttctattcaccaacttacacattcctaagatttgtgcaaaagtaaaggaaacttgtgctgagatggagaggtaaatatcaacaattcaacactctcattcttatatgatgtgttttgtaaaggtttaggcattgaggtaagcctaagttgagaatgagaagccatat

SEQ ID NO: 589 - DNA, 200 bp, Amaranthus rudis
tagggaatcttgtggggctcaaacaaatgagaaccgcaaataactttctaaatatagaaatgggtcactcgtggtgaaaagatccaatatgaaaattagacacttgtgctgagatggaggaagtatcatacttgtaaaaacataatacttgaggctgatgtgactttggtagtaactagtaaccatagtgcaaaaatgcg

SEQ ID NO: 590 - DNA, 200 bp, Amaranthus rudis
cgcatttttgcactatggttactagttactaccaaagtcacatcagcctcaagtattatgtttttacaagtatgatacttcctccatctcagcacaagtgtctaattttcatattggatcttttcaccacgagtgacccatttctatatttagaaagttatttgcggttctcatttgtttgagccccacaagattcccta

SEQ ID NO: 591 - DNA, 200 bp, Amaranthus rudis
ctagtaaccatagtgcaaaaatgcggtaaccggttgcaatcacggtaacgacacgatgatgcggttatcataacgccaaatatcggccaaaagcgtgagatattccttctaacaacccaaaaacgcagtttttttacacctttatatcgcaagaaatatatgttcgttttttgaaaatctttagaacgcggccgttgcga

SEQ ID NO: 592 - DNA, 200 bp, Amaranthus rudis
tcgcaacggccgcgttctaaagattttcaaaaaacgaacatatatttcttgcgatataaaggtgtaaaaaaactgcgtttttgggttgttagaaggaatatctcacgcttttggccgatatttggcgttatgataaccgcatcatcgtgtcgttaccgtgattgcaaccggttaccgcatttttgcactatggttactag

SEQ ID NO: 593 - DNA, 200 bp, Amaranthus rudis
aatctttagaacgcggccgttgcgatgtgatgctatgcggccttattttttcactatggtaatgacaaaacatttgcggatgcacacattggctaccgtttctgatccccttttcatttgtacacatcaatgtaacgtaattccccagctaattcgccttttgaattcggaattctctcaaaattgtggaaaaatagccc

SEQ ID NO: 594 - DNA, 200 bp, Amaranthus rudis
gggctatttttccacaattttgagagaattccgaattcaaaaggcgaattagctggggaattacgttacattgatgtgtacaaatgaaaaggggatcagaaacggtagccaatgtgtgcatccgcaaatgttttgtcattaccatagtgaaaaaataaggccgcatagcatcacatcgcaacggccgcgttctaaagatt

SEQ ID NO: 595 - DNA, 200 bp, Amaranthus rudis
tctcaaaattgtggaaaaatagcccaactcctaccataattcgcttttttcgatttgcaattcgcggggagattagcggatcacatgacaatgatacaaatcctatggatttatgtatgttactgatttaaagacttcaaccccttagattaaatgttgaaaccatataagaatggaatttttaagattttttttatcta

SEQ ID NO: 596 - DNA, 200 bp, Amaranthus rudis
tagataaaaaaaatcttaaaaattccattcttatatggtttcaacatttaatctaaggggttgaagtctttaaatcagtaacatacataaatccataggatttgtatcattgtcatgtgatccgctaatctccccgcgaattgcaaatcgaaaaaagcgaattatggtaggagttgggctatttttccacaattttgaga

SEQ ID NO: 597 - DNA, 200 bp, Amaranthus rudis
gaatttttaagattttttttatctaaattctttcctgaaccctattattaagtagctatggcctactagaggtggttacgattcatcatccttttcatcggcttcatgaatttgtacatatcttggacttctccagttctcctttaattttgtttatctttgttatttcaggagtcctcttttgagtgtctatgctgata

SEQ ID NO: 598 - DNA, 200 bp, Amaranthus rudis
tatcagcatagacactcaaaagaggactcctgaaataacaaagataaacaaaattaaaggagaactggagaagtccaagatatgtacaaattcatgaagccgatgaaaaggatgatgaatcgtaaccacctctagtaggccatagctacttaataatagggttcaggaaagaatttagataaaaaaaatcttaaaaattc

SEQ ID NO: 599 - DNA, 200 bp, Amaranthus rudis
cctcttttgagtgtctatgctgatatgtcggagacatgcaaggtgagcatattcccattttttttatttccgacttatatgttcgtgttctccgtttgtctctttttcgcgcatataatatcgaatgttagccactccccgttactccttctattctgctaacaccgggattttaactatgagggtcctcagaattaatt

SEQ ID NO: 600 - DNA, 200 bp, Amaranthus rudis
aattaattctgaggaccctcatagttaaaatcccggtgttagcagaatagaaggagtaacggggagtggctaacattcgatattatatgcgcgaaaaagagacaaacggagaacacgaacatataagtcggaaataaaaaaaatgggaatatgctcaccttgcatgtctccgacatatcagcatagacactcaaaagagg

SEQ ID NO: 601 - DNA, 200 bp, Amaranthus rudis
actatgagggtcctcagaattaattataaaaattcgacaaaaacaaaaaaaagaaataaaattgatgggtcataacaattttacttgagatattcaacatttattttacaatttttcttaagaaattcagtacatctacactcccgagccactgcatgtgagcgccgcggcttgctgtttaagaaacctttcttagaagt

SEQ ID NO: 602 - DNA, 200 bp, Amaranthus rudis
acttctaagaaaggtttcttaaacagcaagccgcggcgctcacatgcagtggctcgggagtgtagatgtactgaatttcttaagaaaaattgtaaaataaatgttgaatatctcaagtaaaattgttatgacccatcaattttatttcttttttttgtttttgtcgaatttttataattaattctgaggaccctcatagt

SEQ ID NO: 603 - DNA, 200 bp, Amaranthus rudis
tgtttaagaaacctttcttagaagtgtcgactatatgcagtttcttccattcttacgatcatttacaggaatataaggatccaaatagatccatgctggaattggttttcgcacccgcggaggaatggatttcacgaagcgacaccgatattatcgaggcaacaatgaaagagcttgccaagcttttcccggatgaaatc

SEQ ID NO: 604 - DNA, 200 bp, Amaranthus rudis
gatttcatccgggaaaagcttggcaagctctttcattgttgcctcgataatatcggtgtcgcttcgtgaaatccattcctccgcgggtgcgaaaaccaattccagcatggatctatttggatccttatattcctgtaaatgatcgtaagaatggaagaaactgcatatagtcgacacttctaagaaaggtttcttaaaca

SEQ ID NO: 605 - DNA, 200 bp, Amaranthus rudis
tgccaagcttttcccggatgaaatcgctgccgatgggagcaaggccaagatccttaaatatcatgtcgtcaaaactccaaggtgatcgataaacttgtgaaattaaaattggataatatcatgctaccgctagaaacagcattaatgttgtgcccgcgggctcttttataggtcggtttataagacagtgccggattgtg

SEQ ID NO: 606 - DNA, 200 bp, Amaranthus rudis
cacaatccggcactgtcttataaaccgacctataaaagagcccgcgggcacaacattaatgctgtttctagcggtagcatgatattatccaattttaatttcacaagtttatcgatcaccttggagttttgacgacatgatatttaaggatcttggccttgctcccatcggcagcgatttcatccgggaaaagcttggca

SEQ ID NO: 607 - DNA, 200 bp, Amaranthus rudis
gtttataagacagtgccggattgtgaaccttgtcggccgctgcaaagatcaccgatagagggtttctatttagctggtgattacacaaaacaaaaatatttggcttcaatggaaggtgctgttttatctgggaagctttgtgctcaggctattgtacaggtaatcaaagtttgattaaacaccgcgggcatgctgattag

SEQ ID NO: 608 - DNA, 200 bp, Amaranthus rudis
ctaatcagcatgcccgcggtgtttaatcaaactttgattacctgtacaatagcctgagcacaaagcttcccagataaaacagcaccttccattgaagccaaatatttttgttttgtgtaatcaccagctaaatagaaaccctctatcggtgatctttgcagcggccgacaaggttcacaatccggcactgtcttataaac

SEQ ID NO: 609 - DNA, 200 bp, Amaranthus rudis
taaacaccgcgggcatgctgattagacttttcgtattttgattcgatccgaaattgacccaaaaccgaccggaaatcggtgggttataatttagaaaatatgacccgtaaccaaaaaatgactcaaacccaccgtagcccaaatccaatcgttttgacttgtttacctaattttgtcaacttttcttgttccacgtcgtt

SEQ ID NO: 610 - DNA, 200 bp, Amaranthus rudis
aacgacgtggaacaagaaaagttgacaaaattaggtaaacaagtcaaaacgattggatttgggctacggtgggtttgagtcattttttggttacgggtcatattttctaaattataacccaccgatttccggtcggttttgggtcaatttcggatcgaatcaaaatacgaaaagtctaatcagcatgcccgcggtgttta

SEQ ID NO: 611 - DNA, 200 bp, Amaranthus rudis
tcaacttttcttgttccacgtcgttagttttctgtcgggagtcgggacccactatctttctagtctgtttttgtatttcttttttctttgttgatgcttttattcgtttttacctagttatgtttatatatttatgtgttttatttatttatatgtttttgactaccgaggtatgatgattgtttctatgagcggatata

SEQ ID NO: 612 - DNA, 200 bp, Amaranthus rudis
tatatccgctcatagaaacaatcatcatacctcggtagtcaaaaacatataaataaataaaacacataaatatataaacataactaggtaaaaacgaataaaagcatcaacaaagaaaaaagaaatacaaaaacagactagaaagatagtgggtcccgactcccgacagaaaactaacgacgtggaacaagaaaagttga

SEQ ID NO: 613 - DNA, 200 bp, Amaranthus rudis
atgattgtttctatgagcggatatactgagtatgatgatgatgatttattcttttttataaaaaaaaagttaaaggtctttttttgaaaatattttagtgatttttttgacctgatcaaatttcaattcgaaccaaaaataacccaagcgaaagtgactcaacccgaaacctaccctgatctaattgtaatgatagcttt

SEQ ID NO: 614 - DNA, 200 bp, Amaranthus rudis
aaagctatcattacaattagatcagggtaggtttcgggttgagtcactttcgcttgggttatttttggttcgaattgaaatttgatcaggtcaaaaaaatcactaaaatattttcaaaaaaagacctttaactttttttttataaaaaagaataaatcatcatcatcatactcagtatatccgctcatagaaacaatcat

SEQ ID NO: 615 - DNA, 200 bp, Amaranthus rudis
gatattatcgaggcaacaatgaaagagcttgccaagcttttcccggatgaaatcgctgccgatgggagcaaggccaagatccttaaatatcatgtcgtcaaaactccaaggtgatcgataaacttgtgaaattaaaattggataatttcatgctaccgctagaaacagcattaatgttgtacccgtgggctcttttatag

SEQ ID NO: 616 - DNA, 200 bp, Amaranthus rudis
ctataaaagagcccacgggtacaacattaatgctgtttctagcggtagcatgaaattatccaattttaatttcacaagtttatcgatcaccttggagttttgacgacatgatatttaaggatcttggccttgctcccatcggcagcgatttcatccgggaaaagcttggcaagctctttcattgttgcctcgataatatc

SEQ ID NO: 617 - DNA, 200 bp, Amaranthus rudis
gttgtacccgtgggctcttttataggtctgtttataagacagtgccggattgtgaaccttgtcggccgctgcaaagatcaccgatagagggtttctatttagctggtgattacacaaaacaaaaatatttggcttcaatggaaggtgctgttttatctgggaagctttgtgctcaggctattgtacaggtaatcaaagtt

SEQ ID NO: 618 - DNA, 200 bp, Amaranthus rudis
aactttgattacctgtacaatagcctgagcacaaagcttcccagataaaacagcaccttccattgaagccaaatatttttgttttgtgtaatcaccagctaaatagaaaccctctatcggtgatctttgcagcggccgacaaggttcacaatccggcactgtcttataaacagacctataaaagagcccacgggtacaac

SEQ ID NO: 619 - DNA, 200 bp, Amaranthus rudis
ggctattgtacaggtaatcaaagtttgattaaacaccgcgggcatgctgattagacttttcgtattttgattcgatccgaaattgacccaaaaccgaccggaaatcggtgggttataatttagaaaatatgacccgtaaccaaaaaatgactcaaacccaccgtagcccaaatccaatcgttttgacttgtttacctaat

SEQ ID NO: 620 - DNA, 200 bp, Amaranthus rudis
attaggtaaacaagtcaaaacgattggatttgggctacggtgggtttgagtcattttttggttacgggtcatattttctaaattataacccaccgatttccggtcggttttgggtcaatttcggatcgaatcaaaatacgaaaagtctaatcagcatgcccgcggtgtttaatcaaactttgattacctgtacaatagcc

SEQ ID NO: 621 - DNA, 200 bp, Amaranthus rudis
gccttttgaatgtacatattctattcttgtaatcatttgatcagccaacattaagaccgttttcaatgagaacttccttccgcaatacacaaaaagatcctcaagactaggccctaataaatcaatcacgagaatattatcttccccatccactccagaccatttcacagttggaatcccacttcctccttgaagaatgg

SEQ ID NO: 622 - DNA, 200 bp, Amaranthus rudis
ccattcttcaaggaggaagtgggattccaactgtgaaatggtctggagtggatggggaagataatattctcgtgattgatttattagggcctagtcttgaggatctttttgtgtattgcggaaggaagttctcattgaaaacggtcttaatgttggctgatcaaatgattacaagaatagaatatgtacattcaaaaggc

SEQ ID NO: 623 - DNA, 200 bp, Amaranthus rudis
atcccacttcctccttgaagaatggtgtataccttcgcctcatacagtaattgcggatgcttcgtcttggtattctcgagctttacagcgacaatctcgaaggtgtcgatatgagtagcaaggaaaatttcaccgaaggaaccactgccgatcttgcgacctagcttgtacttgcctccgacgatccgatccataacgat

SEQ ID NO: 624 - DNA, 200 bp, Amaranthus rudis
atcgttatggatcggatcgtcggaggcaagtacaagctaggtcgcaagatcggcagtggttccttcggtgaaattttccttgctactcatatcgacaccttcgagattgtcgctgtaaagctcgagaataccaagacgaagcatccgcaattactgtatgaggcgaaggtatacaccattcttcaaggaggaagtgggat

SEQ ID NO: 625 - DNA, 200 bp, Amaranthus rudis
ctccgacgatccgatccataacgatttcgataaattaaacaaccaaaactaccaccgttgaaattgattgatatggtgaaatcaatagcgtgaaattgaaaacataagttaggattttggatagataaaggggaaagtaggtgccgatgaagggaagagagagaaaactcaagctaaaagcgggtaagcagacatccaga

SEQ ID NO: 626 - DNA, 200 bp, Amaranthus rudis
tctggatgtctgcttacccgcttttagcttgagttttctctctcttcccttcatcggcacctactttcccctttatctatccaaaatcctaacttatgttttcaatttcacgctattgatttcaccatatcaatcaatttcaacggtggtagttttggttgtttaatttatcgaaatcgttatggatcggatcgtcggag

SEQ ID NO: 627 - DNA, 200 bp, Amaranthus rudis
aaaagcgggtaagcagacatccagagagagaaagagaaagacgatgagtgtatgaggtggagttttggggatttttaattagggaaagggaaggaaggtggaaatgggaggaattctttggggcttatccaaatatccaaaatctatttggagaacttggtataaatgatcgattgcaatggaaggagcactctatgatt

SEQ ID NO: 628 - DNA, 200 bp, Amaranthus rudis
aatcatagagtgctccttccattgcaatcgatcatttataccaagttctccaaatagattttggatatttggataagccccaaagaattcctcccatttccaccttccttccctttccctaattaaaaatccccaaaactccacctcatacactcatcgtctttctctttctctctctggatgtctgcttacccgctttt

SEQ ID NO: 629 - DNA, 200 bp, Amaranthus rudis
gcaatggaaggagcactctatgatttttgcaatgcctagcaagcctggtgaattcagtcgctttgattttcccgaagtcctgcctgcaccattaaatggcatatgggcaatcctaaggaataatgaaatgctaacctggccagaaaaaatcaagtttgccattggcttgttgcctgctatggctggcggacagtcatatg

SEQ ID NO: 630 - DNA, 200 bp, Amaranthus rudis
catatgactgtccgccagccatagcaggcaacaagccaatggcaaacttgattttttctggccaggttagcatttcattattccttaggattgcccatatgccatttaatggtgcaggcaggacttcgggaaaatcaaagcgactgaattcaccaggcttgctaggcattgcaaaaatcatagagtgctccttccattgc

SEQ ID NO: 631 - DNA, 200 bp, Amaranthus rudis
gctatggctggcggacagtcatatgttgaagcacaagacggtttgagtgtccaagagtggatgagaaaacaaggagtacccgatcgtgtaactgatgaagtatttattgccatgtcaaaggcactgaacttcataaatcccgatgaactttcaatgcagtgcatcttgattgctctgaaccgattcctgcaggagaaaca

SEQ ID NO: 632 - DNA, 200 bp, Amaranthus rudis
tgtttctcctgcaggaatcggttcagagcaatcaagatgcactgcattgaaagttcatcgggatttatgaagttcagtgcctttgacatggcaataaatacttcatcagttacacgatcgggtactccttgttttctcatccactcttggacactcaaaccgtcttgtgcttcaacatatgactgtccgccagccatagc

SEQ ID NO: 633 - DNA, 200 bp, Amaranthus rudis
tgaaccgattcctgcaggagaaacatggttctaagatggccttcctagacggaaaccctccagagaggctgtgcatgcctattgttgagcacattgagtcactaggtggtgaagttaaacttaactctcgtatacaaaagattcagttggatcagagtggaagcgtaagagttttttgctaactaatgggagggaaataa

SEQ ID NO: 634 - DNA, 200 bp, Amaranthus rudis
ttatttccctcccattagttagcaaaaaactcttacgcttccactctgatccaactgaatcttttgtatacgagagttaagtttaacttcaccacctagtgactcaatgtgctcaacaataggcatgcacagcctctctggagggtttccgtctaggaaggccatcttagaaccatgtttctcctgcaggaatcggttca

SEQ ID NO: 635 - DNA, 200 bp, Amaranthus rudis
ttgctaactaatgggagggaaataagaggagatgcctatgtatttgctaccccagttgacattttgaagctgttgctacccgatacttggaaggaaatctcatacttcaaaaagcttgagaaattagtgggcgttcctgtgattaatgttcacatatggtttgacagaaaattaaagaatacgtatgaccatctactctt

SEQ ID NO: 636 - DNA, 200 bp, Amaranthus rudis
aagagtagatggtcatacgtattctttaattttctgtcaaaccatatgtgaacattaatcacaggaacgcccactaatttctcaagctttttgaagtatgagatttccttccaagtatcgggtagcaacagcttcaaaatgtcaactggggtagcaaatacataggcatctcctcttatttccctcccattagttagcaa

SEQ ID NO: 637 - DNA, 200 bp, Amaranthus rudis
agaatacgtatgaccatctactcttcagcaggagtcctcttttgagtgtctatgctgatatgtcagagacatgcaaagaatataaggatccaaatagatccatgctggaattggttttcgcacccgcggaggaatggatttcacgaagcgacactgatattattgaggcaacaatgcaagagctcgccaagcttttccca

SEQ ID NO: 638 - DNA, 200 bp, Amaranthus rudis
tgggaaaagcttggcgagctcttgcattgttgcctcaataatatcagtgtcgcttcgtgaaatccattcctccgcgggtgcgaaaaccaattccagcatggatctatttggatccttatattctttgcatgtctctgacatatcagcatagacactcaaaagaggactcctgctgaagagtagatggtcatacgtattct

SEQ ID NO: 639 - DNA, 200 bp, Amaranthus rudis
gcaagagctcgccaagcttttcccagatgaaatcgctgctgatgggagcaaggccaagatccttaaatatcatgtcgtcaaaactccaaggtcggtttataagacagtaccggattgtgagccttgtcggccgctgcaaagatcaccgatagagggtttctatttagctggtgattacacaaaacaaaaatatttggctt

SEQ ID NO: 640 - DNA, 200 bp, Amaranthus rudis
aagccaaatatttttgttttgtgtaatcaccagctaaatagaaaccctctatcggtgatctttgcagcggccgacaaggctcacaatccggtactgtcttataaaccgaccttggagttttgacgacatgatatttaaggatcttggccttgctcccatcagcagcgatttcatctgggaaaagcttggcgagctcttgc

SEQ ID NO: 641 - DNA, 200 bp, Amaranthus rudis
tacacaaaacaaaaatatttggcttctatggaaggtgctgtcttatctgggaagctttgtgctcaggctattgtacaggattatgatctgctgagttctcgagcacaaagagaattggcggcgacaagcaatgtataaccctggattgctttgacatccgccattgattttcattcgagatctggattgggaatctgatc

SEQ ID NO: 642 - DNA, 200 bp, Amaranthus rudis
gatcagattcccaatccagatctcgaatgaaaatcaatggcggatgtcaaagcaatccagggttatacattgcttgtcgccgccaattctctttgtgctcgagaactcagcagatcataatcctgtacaatagcctgagcacaaagcttcccagataagacagcaccttccatagaagccaaatatttttgttttgtgta

SEQ ID NO: 643 - DNA, 200 bp, Amaranthus rudis
cgagatctggattgggaatctgatcagtcatcgaaaaatgatcagctgtaaacaaaattatgggggttgcacattggtgttctcaagttcttgatttataaattcttcagaaagaagatttatttgtaatgatatatcaattgattgaaatatgtatagcttacttctagggaattatgtatgtgcaccagttaacttga

SEQ ID NO: 644 - DNA, 200 bp, Amaranthus rudis
tcaagttaactggtgcacatacataattccctagaagtaagctatacatatttcaatcaattgatatatcattacaaataaatcttctttctgaagaatttataaatcaagaacttgagaacaccaatgtgcaacccccataattttgtttacagctgatcatttttcgatgactgatcagattcccaatccagatctcg

SEQ ID NO: 645 - DNA, 200 bp, Amaranthus rudis
tccatttttcttgttctttcagtttcacataccctctcatcaatcaatatccaaaactattacattttccaaactatttcaaacccaaaaatcaaaaacttttgattgaagaacaaactttgggggttttggaaaatgagtcattttggatatgcttgtgctactcaatccacatcaagatatgttcttttaggaaattc

SEQ ID NO: 646 - DNA, 200 bp, Amaranthus rudis
gaatttcctaaaagaacatatcttgatgtggattgagtagcacaagcatatccaaaatgactcattttccaaaacccccaaagtttgttcttcaatcaaaagtttttgatttttgggtttgaaatagtttggaaaatgtaatagttttggatattgattgatgagagggtatgtgaaactgaaagaacaagaaaaatgga

SEQ ID NO: 647 - DNA, 200 bp, Amaranthus rudis
caagatatgttcttttaggaaattcaaataaccccacttcaatttcatctattggaagtgattttttgggtcattctgtgagaaatttcagtgttagtaaagtttatgggggaaagcaaagaaatgggcactgccctttaaaggttgtttgtatagattatcctaggccagagcttgaaagtacatccaatttcttggaa

SEQ ID NO: 648 - DNA, 200 bp, Amaranthus rudis
ttccaagaaattggatgtactttcaagctctggcctaggataatctatacaaacaacctttaaagggcagtgcccatttctttgctttcccccataaactttactaacactgaaatttctcacagaatgacccaaaaaatcacttccaatagatgaaattgaagtggggttatttgaatttcctaaaagaacatatcttg

SEQ ID NO: 649 - DNA, 200 bp, Amaranthus rudis
tgaaagtacatccaatttcttggaagccgcctacttatcttctacttttcggaattcgcctcgtcctcagaagccattagaagttgtaattgccggagcaggtttggctggtctatccacggcaaagtatttagctgatgcaggtcacaaacccatattgctggaagcacgagatgttttaggaggaaaggttgcagcgt

SEQ ID NO: 650 - DNA, 200 bp, Amaranthus rudis
acgctgcaacctttcctcctaaaacatctcgtgcttccagcaatatgggtttgtgacctgcatcagctaaatactttgccgtggatagaccagccaaacctgctccggcaattacaacttctaatggcttctgaggacgaggcgaattccgaaaagtagaagataagtaggcggcttccaagaaattggatgtactttca

SEQ ID NO: 651 - DNA, 200 bp, Amaranthus rudis
gttttaggaggaaaggttgcagcgtggaaggatgaggatggtgactggtacgagactgggctacatatattctttggggcttatccaaatatccaaaatctatttggagaacttggtataaatgatcgattgcaatggaaggagcactctatgatttttgcaatgcctagcaagcctggtgaattcagtcgctttgattt

SEQ ID NO: 652 - DNA, 200 bp, Amaranthus rudis
aaatcaaagcgactgaattcaccaggcttgctaggcattgcaaaaatcatagagtgctccttccattgcaatcgatcatttataccaagttctccaaatagattttggatatttggataagccccaaagaatatatgtagcccagtctcgtaccagtcaccatcctcatccttccacgctgcaacctttcctcctaaaac

SEQ ID NO: 653 - DNA, 200 bp, Amaranthus rudis
ctggtgaattcagtcgctttgattttcccgaagtcctgcctgcaccattaaatggcatatgggcaatcctaaggaataatgaaatgctaacctggccagaaaaaatcaagtttgccattggcttgttgcctgctatggctggcggacagtcatatgttgaagcacaagacggtttgagtgtccaagagtggatgagaaaa

SEQ ID NO: 654 - DNA, 200 bp, Amaranthus rudis
ttttctcatccactcttggacactcaaaccgtcttgtgcttcaacatatgactgtccgccagccatagcaggcaacaagccaatggcaaacttgattttttctggccaggttagcatttcattattccttaggattgcccatatgccatttaatggtgcaggcaggacttcgggaaaatcaaagcgactgaattcaccag

SEQ ID NO: 655 - DNA, 200 bp, Amaranthus rudis
gagtgtccaagagtggatgagaaaacaaggagtacccgatcgtgtaactgatgaagtatttattgccatgtcaaaggcactgaacttcataaatcccgatgaactttcaatgcagtgcatcttgattgctctgaaccgattcctgcaggagaaacatggttctaagatggccttcctagacggaaaccctccagagaggc

SEQ ID NO: 656 - DNA, 200 bp, Amaranthus rudis
gcctctctggagggtttccgtctaggaaggccatcttagaaccatgtttctcctgcaggaatcggttcagagcaatcaagatgcactgcattgaaagttcatcgggatttatgaagttcagtgcctttgacatggcaataaatacttcatcagttacacgatcgggtactccttgttttctcatccactcttggacactc

SEQ ID NO: 657 - DNA, 200 bp, Amaranthus rudis
ctagacggaaaccctccagagaggctgtgcatgcctattgttgagcacattgagtcactaggtggtgaagttaaacttaactctcgtatacaaaagattcagttggatcagagtggaagcgtaagagttttttgctaactaatgggagggaaataagaggagatgcctatgtatttgctaccccagttgacattttgaag

SEQ ID NO: 658 - DNA, 200 bp, Amaranthus rudis
cttcaaaatgtcaactggggtagcaaatacataggcatctcctcttatttccctcccattagttagcaaaaaactcttacgcttccactctgatccaactgaatcttttgtatacgagagttaagtttaacttcaccacctagtgactcaatgtgctcaacaataggcatgcacagcctctctggagggtttccgtctag

SEQ ID NO: 659 - DNA, 200 bp, Amaranthus rudis
tgctaccccagttgacattttgaagctgttgctacccgatacttggaaggaaatctcatacttcaaaaagcttgagaaattagtgggcgttcctgtgattaatgttcacatatggtttgacagaaaattaaagaatacgtatgaccatctactcttcagcaggagtcctcttttgagtgtctatgctgatatgtcagaga

SEQ ID NO: 660 - DNA, 200 bp, Amaranthus rudis
tctctgacatatcagcatagacactcaaaagaggactcctgctgaagagtagatggtcatacgtattctttaattttctgtcaaaccatatgtgaacattaatcacaggaacgcccactaatttctcaagctttttgaagtatgagatttccttccaagtatcgggtagcaacagcttcaaaatgtcaactggggtagca

SEQ ID NO: 661 - DNA, 200 bp, Amaranthus rudis
agtgtctatgctgatatgtcagagacatgcaaagaatataaggatccaaatagatccatgctggaattggttttcgcacccgcggaggaatggatttcacgaagcgacactgatattattgaggcaacaatgcaagagctcgccaagcttttcccagatgaaatcgctgctgatgggagcaaggccaagatccttaaata

SEQ ID NO: 662 - DNA, 200 bp, Amaranthus rudis
tatttaaggatcttggccttgctcccatcagcagcgatttcatctgggaaaagcttggcgagctcttgcattgttgcctcaataatatcagtgtcgcttcgtgaaatccattcctccgcgggtgcgaaaaccaattccagcatggatctatttggatccttatattctttgcatgtctctgacatatcagcatagacact

SEQ ID NO: 663 - DNA, 200 bp, Amaranthus rudis
ggagcaaggccaagatccttaaatatcatgtcgtcaaaactccaaggtcggtttataagacagtaccggattgtgagccttgtcggccgctgcaaagatcaccgatagagggtttctatttagctggtgattacacaaaacaaaaatatttggcttctatggaaggtgctgtcttatctgggaagctttgtgctcaggct

SEQ ID NO: 664 - DNA, 200 bp, Amaranthus rudis
agcctgagcacaaagcttcccagataagacagcaccttccatagaagccaaatatttttgttttgtgtaatcaccagctaaatagaaaccctctatcggtgatctttgcagcggccgacaaggctcacaatccggtactgtcttataaaccgaccttggagttttgacgacatgatatttaaggatcttggccttgctcc

SEQ ID NO: 665 - DNA, 200 bp, Amaranthus rudis
atctgggaagctttgtgctcaggctattgtacaggattatgatctgctgagttctcgagcacaaagagaattggcggcgacaagcaatgtataaccctggattgctttgacatccgccattgattttcattcgagatctggattgggaatctgatcagtcatcgaaaaatgatcagctgtaaacaaaattatgggggttg

SEQ ID NO: 666 - DNA, 200 bp, Amaranthus rudis
caacccccataattttgtttacagctgatcatttttcgatgactgatcagattcccaatccagatctcgaatgaaaatcaatggcggatgtcaaagcaatccagggttatacattgcttgtcgccgccaattctctttgtgctcgagaactcagcagatcataatcctgtacaatagcctgagcacaaagcttcccagat

SEQ ID NO: 667 - DNA, 200 bp, Amaranthus rudis
tgaatgtgagaaccgacttctcatactttattttacttacaggtttggctggtctatccacagcaaagtatttagctgatgcaggtcacaaacccatattgctggaagcacgagatgttttaggaggaaaggtgtgtgctatacttttcttgtagcttatgaaacaactccattgtgcttactctctaattagtttactt

SEQ ID NO: 668 - DNA, 200 bp, Amaranthus rudis
aagtaaactaattagagagtaagcacaatggagttgtttcataagctacaagaaaagtatagcacacacctttcctcctaaaacatctcgtgcttccagcaatatgggtttgtgacctgcatcagctaaatactttgctgtggatagaccagccaaacctgtaagtaaaataaagtatgagaagtcggttctcacattca

SEQ ID NO: 669 - DNA, 200 bp, Amaranthus rudis
tgcttactctctaattagtttacttcagactatcagatgatttttgaactttttcctccctctgttcggctgtataattatatatgagaaacatgtttaaaaatgggtgcattaacatatatgaagttttttttatcaaggcgagattttgtcatccaaaaactttacttctgaacatgctgtctgatcctgtttcttta

SEQ ID NO: 670 - DNA, 200 bp, Amaranthus rudis
taaagaaacaggatcagacagcatgttcagaagtaaagtttttggatgacaaaatctcgccttgataaaaaaaacttcatatatgttaatgcacccatttttaaacatgtttctcatatataattatacagccgaacagagggaggaaaaagttcaaaaatcatctgatagtctgaagtaaactaattagagagtaagca

SEQ ID NO: 671 - DNA, 200 bp, Amaranthus rudis
catgctgtctgatcctgtttctttatcttcatttgttgggattttcttgaggttcatgactactttcagttattatagttacccatcctgcataaatctgagtttacagttatagtaatgaaaataaataggctaattatattctcgtcggtcatcacagtatgatgaatcttgggctaatatgaagatgaggtaggaag

SEQ ID NO: 672 - DNA, 200 bp, Amaranthus rudis
cttcctacctcatcttcatattagcccaagattcatcatactgtgatgaccgacgagaatataattagcctatttattttcattactataactgtaaactcagatttatgcaggatgggtaactataataactgaaagtagtcatgaacctcaagaaaatcccaacaaatgaagataaagaaacaggatcagacagcatg

SEQ ID NO: 673 - DNA, 200 bp, Amaranthus rudis
gctaatatgaagatgaggtaggaagaagaatttgtgttagtatgataatatgtgcccgccctaagcaagtgcaagccttgcctacgcctagggccccccaaaaattttagttttcaactagtgctaacgttcgaacttttctatatatatacaatagtttaggggcccaaattagtttaggggcccaaataatcttaggg

SEQ ID NO: 674 - DNA, 200 bp, Amaranthus rudis
ccctaagattatttgggcccctaaactaatttgggcccctaaactattgtatatatatagaaaagttcgaacgttagcactagttgaaaactaaaatttttggggggccctaggcgtaggcaaggcttgcacttgcttagggcgggcacatattatcatactaacacaaattcttcttcctacctcatcttcatattagc

SEQ ID NO: 675 - DNA, 200 bp, Amaranthus rudis
tttaggggcccaaataatcttaggggcccaaataatctttcgggcccaaataatctttcgccccgggcccctaaaaacctagggtcggctagtgccaagagaaatattgttgtgcaaagtttcttggtattttttcttgtgcttacaattcttgctccacagattgcagcgtggaaggatgaggatggtgactggtatga

SEQ ID NO: 676 - DNA, 200 bp, Amaranthus rudis
tcataccagtcaccatcctcatccttccacgctgcaatctgtggagcaagaattgtaagcacaagaaaaaataccaagaaactttgcacaacaatatttctcttggcactagccgaccctaggtttttaggggcccggggcgaaagattatttgggcccgaaagattatttgggcccctaagattatttgggcccctaaa

SEQ ID NO: 677 - DNA, 200 bp, Amaranthus rudis
aggatgaggatggtgactggtatgagactgggctacatatattctgtgagtgatcttttaattttctgcttagttgggtagttacccgtgtacttattatgtgcactctagtcatgtttattggaaaaatttactgcatatttatcagtccgatgtactgaacatcttcatattttcttgaagttggggcatatccaaat

SEQ ID NO: 678 - DNA, 200 bp, Amaranthus rudis
atttggatatgccccaacttcaagaaaatatgaagatgttcagtacatcggactgataaatatgcagtaaatttttccaataaacatgactagagtgcacataataagtacacgggtaactacccaactaagcagaaaattaaaagatcactcacagaatatatgtagcccagtctcataccagtcaccatcctcatcct

SEQ ID NO: 679 - DNA, 200 bp, Amaranthus rudis
tcttgaagttggggcatatccaaatatccaaaatctatttggagaacttggtataaatgaccgattgcaatggaaggagcactctatgatttttgcaatgcctagcaaacccggtgaattcagtcgctttgattttcccgaagtcctgcctgcaccattaaatggttagtatatcggtgatggtttttgttggctgccaa

SEQ ID NO: 680 - DNA, 200 bp, Amaranthus rudis
ttggcagccaacaaaaaccatcaccgatatactaaccatttaatggtgcaggcaggacttcgggaaaatcaaagcgactgaattcaccgggtttgctaggcattgcaaaaatcatagagtgctccttccattgcaatcggtcatttataccaagttctccaaatagattttggatatttggatatgccccaacttcaaga

SEQ ID NO: 681 - DNA, 200 bp, Amaranthus rudis
ggtgatggtttttgttggctgccaaattacttgatgcaatgcattaccttgtaaaatactccttccgtccccctgattttgccccatatactattttagtccgttcaattgaatttgcccattattatttttggacgtgattccacctataatacttgctataacctacaatttatttctctttcctacatcaaaaacta

SEQ ID NO: 682 - DNA, 200 bp, Amaranthus rudis
tagtttttgatgtaggaaagagaaataaattgtaggttatagcaagtattataggtggaatcacgtccaaaaataataatgggcaaattcaattgaacggactaaaatagtatatggggcaaaatcagggggacggaaggagtattttacaaggtaatgcattgcatcaagtaatttggcagccaacaaaaaccatcacc

SEQ ID NO: 683 - DNA, 200 bp, Amaranthus spinosus
caatcctaaggaataatgaaatgctaacctggccagaaaaaatcaagtttgccattggcttgttgcctgctatggcgggcggacagtcatatgttgaagcacaagatggtttgagtgtccaagagtggatgagaaaacaaggagtacccgatcgtgtaactgatgaagtatttattgccatgtcaaaggcactgaacttc

SEQ ID NO: 684 - DNA, 200 bp, Amaranthus spinosus
gaagttcagtgcctttgacatggcaataaatacttcatcagttacacgatcgggtactccttgttttctcatccactcttggacactcaaaccatcttgtgcttcaacatatgactgtccgcccgccatagcaggcaacaagccaatggcaaacttgattttttctggccaggttagcatttcattattccttaggattg

SEQ ID NO: 685 - DNA, 200 bp, Amaranthus spinosus
tgccatgtcaaaggcactgaacttcataaatcccgatgaactttcaatgcagtgcatcttgattgctctgaaccgattcctgcaggagaaacatggttctaagatggccttcctagacggaaaccctccagagaggctgtgcatgcctattgttaagcacattgagtcactaggtggtgaagttaaacttaattctcgta

SEQ ID NO: 686 - DNA, 200 bp, Amaranthus spinosus
tacgagaattaagtttaacttcaccacctagtgactcaatgtgcttaacaataggcatgcacagcctctctggagggtttccgtctaggaaggccatcttagaaccatgtttctcctgcaggaatcggttcagagcaatcaagatgcactgcattgaaagttcatcgggatttatgaagttcagtgcctttgacatggca

SEQ ID NO: 687 - DNA, 200 bp, Amaranthus spinosus
ggtgaagttaaacttaattctcgtatacaaaagattcagttggatcagagtggaagcgtgaagagttttttgctaaataacgggagggaaatacgaggagatgcctatgtttttgccaccccagttgacattttgaagctgttactacccgatacttggaaggaaatctcatacttcaaaaagcttgagaaattagtggg

SEQ ID NO: 688 - DNA, 200 bp, Amaranthus spinosus
cccactaatttctcaagctttttgaagtatgagatttccttccaagtatcgggtagtaacagcttcaaaatgtcaactggggtggcaaaaacataggcatctcctcgtatttccctcccgttatttagcaaaaaactcttcacgcttccactctgatccaactgaatcttttgtatacgagaattaagtttaacttcacc

SEQ ID NO: 689 - DNA, 200 bp, Amaranthus spinosus
tcaaaaagcttgagaaattagtgggcgttcctgtgattaatgttcacatatggtttgacagaaaattaaagaatacatatgaccatctactcttcagcaggagtcctcttttgagtgtctatgctgatatgtcggagacatgcaaggaatataaggatccaaatagatccatgctggaactggtttttgcacccgcggag

SEQ ID NO: 690 - DNA, 200 bp, Amaranthus spinosus
ctccgcgggtgcaaaaaccagttccagcatggatctatttggatccttatattccttgcatgtctccgacatatcagcatagacactcaaaagaggactcctgctgaagagtagatggtcatatgtattctttaattttctgtcaaaccatatgtgaacattaatcacaggaacgcccactaatttctcaagctttttga

SEQ ID NO: 691 - DNA, 200 bp, Amaranthus spinosus
ggaactggtttttgcacccgcggaggaatggatttctcgaagtgacactgatattatcgaggctacaatgacagagcttgccaagcttttcccggatgaaatcgctgccgatggaagcaaggccaagatcctcaaatatcatgtcgtcaaaactccaaggtcggtttataagactgtaccagattgtgaaccttgtcggc

SEQ ID NO: 692 - DNA, 200 bp, Amaranthus spinosus
gccgacaaggttcacaatctggtacagtcttataaaccgaccttggagttttgacgacatgatatttgaggatcttggccttgcttccatcggcagcgatttcatccgggaaaagcttggcaagctctgtcattgtagcctcgataatatcagtgtcacttcgagaaatccattcctccgcgggtgcaaaaaccagttcc

SEQ ID NO: 693 - DNA, 200 bp, Amaranthus spinosus
ggatatgcttgtgccactcaatccacatcaagatatgttcttttaggaaattcaaataaccccacttcaatttcatctattggaagtgactttttgggtcattctgtaagaaatttcagtgttagtaaagtttatgggggaaagcaaagaaatgggcattgccctttaaaggttgtttgtatagattatcctaggccaga

SEQ ID NO: 694 - DNA, 200 bp, Amaranthus spinosus
tctggcctaggataatctatacaaacaacctttaaagggcaatgcccatttctttgctttcccccataaactttactaacactgaaatttcttacagaatgacccaaaaagtcacttccaatagatgaaattgaagtggggttatttgaatttcctaaaagaacatatcttgatgtggattgagtggcacaagcatatcc

SEQ ID NO: 695 - DNA, 200 bp, Amaranthus spinosus
tttgtatagattatcctaggccagagcttgaaagtacatcaaatttcttggaagccgcctacttatcttctacttttcggaattcgcctcgtcctcagaagccattagaagttgtaattgctggagcaggtttggctggtctatccacggcaaagtatttagctgatgcaggtcacaaacccatattgttggaagcacga

SEQ ID NO: 696 - DNA, 200 bp, Amaranthus spinosus
tcgtgcttccaacaatatgggtttgtgacctgcatcagctaaatactttgccgtggatagaccagccaaacctgctccagcaattacaacttctaatggcttctgaggacgaggcgaattccgaaaagtagaagataagtaggcggcttccaagaaatttgatgtactttcaagctctggcctaggataatctatacaaa

SEQ ID NO: 697 - DNA, 200 bp, Amaranthus spinosus
caaacccatattgttggaagcacgagatgttttaggaggaaaggttgcagcgtggaaggatgaggatggtgactggtatgagactgggctacatatattctttggggcatatccaaatatccaaaatctatttggagaacttggtataaatgaccgactgcaatggaaggagcactctatgatttttgcaatgcctagca

SEQ ID NO: 698 - DNA, 200 bp, Amaranthus spinosus
tgctaggcattgcaaaaatcatagagtgctccttccattgcagtcggtcatttataccaagttctccaaatagattttggatatttggatatgccccaaagaatatatgtagcccagtctcataccagtcaccatcctcatccttccacgctgcaacctttcctcctaaaacatctcgtgcttccaacaatatgggtttg

SEQ ID NO: 699 - DNA, 200 bp, Amaranthus viridis
aaaacttttgattgaagaacaaactttggggttttggaaaatgagtcattttggatatgcttgtgctactcaatccacatcaagatatgttcttttgggaaattcaaataaccccacttcaatttcatctattggaagtgattttttgggtcattctgtgagaaatttcagtgttagtaaagtttatggggcaaagcaaa

SEQ ID NO: 700 - DNA, 200 bp, Amaranthus viridis
tttgctttgccccataaactttactaacactgaaatttctcacagaatgacccaaaaaatcacttccaatagatgaaattgaagtggggttatttgaatttcccaaaagaacatatcttgatgtggattgagtagcacaagcatatccaaaatgactcattttccaaaaccccaaagtttgttcttcaatcaaaagtttt

SEQ ID NO: 701 - DNA, 200 bp, Amaranthus viridis
agtaaagtttatggggcaaagcaaagaaatgggcactgccctttaaaggttgtttgtatagattatcctaggcctgagcttgaaagtacatccaatttcttggaagccgcctacttatcttctacttttcggaattcgcctcgtcctcagaagccattagaagttgtaattgctggagcaggtttggctggtctatccac

SEQ ID NO: 702 - DNA, 200 bp, Amaranthus viridis
gtggatagaccagccaaacctgctccagcaattacaacttctaatggcttctgaggacgaggcgaattccgaaaagtagaagataagtaggcggcttccaagaaattggatgtactttcaagctcaggcctaggataatctatacaaacaacctttaaagggcagtgcccatttctttgctttgccccataaactttact

SEQ ID NO: 703 - DNA, 200 bp, Amaranthus viridis
gagcaggtttggctggtctatccacggcaaagtatttagctgatgcaggtcacaaacccatattgttggaagcacgagatgttttaggaggaaaggttgcagcgtggaaggatgaggatggtgactggtatgagactgggctacatatattctttggggcatatccaaatatccaaaatctatttggagaacttggtata

SEQ ID NO: 704 - DNA, 200 bp, Amaranthus viridis
tataccaagttctccaaatagattttggatatttggatatgccccaaagaatatatgtagcccagtctcataccagtcaccatcctcatccttccacgctgcaacctttcctcctaaaacatctcgtgcttccaacaatatgggtttgtgacctgcatcagctaaatactttgccgtggatagaccagccaaacctgctc

SEQ ID NO: 705 - DNA, 200 bp, Amaranthus viridis
aaatctatttggagaacttggtataaatgaccgactgcaatggaaggagcactctatgatttttgcaatgcctagcaagcccggtgaattcagtcgctttgattttccagaaatcctgcctgcaccattaaatggcatatgggcaatcctaaggaataatgaaatgctaacctggccagaaaaaatcaagtttgccattg

SEQ ID NO: 706 - DNA, 200 bp, Amaranthus viridis
caatggcaaacttgattttttctggccaggttagcatttcattattccttaggattgcccatatgccatttaatggtgcaggcaggatttctggaaaatcaaagcgactgaattcaccgggcttgctaggcattgcaaaaatcatagagtgctccttccattgcagtcggtcatttataccaagttctccaaatagattt

SEQ ID NO: 707 - DNA, 200 bp, Amaranthus viridis
ccagaaaaaatcaagtttgccattggcttgttgcctgctatggcgggcggacagtcatatgttgaagcacaagatggtttgagtgtccaagagtggatgagaaaacaaggagtacctgatcgtgtaactgatgaagtgtttattgccatgtcaaaggcactgaacttcataaatcccgatgaactttcaatgcagtgcat

SEQ ID NO: 708 - DNA, 200 bp, Amaranthus viridis
atgcactgcattgaaagttcatcgggatttatgaagttcagtgcctttgacatggcaataaacacttcatcagttacacgatcaggtactccttgttttctcatccactcttggacactcaaaccatcttgtgcttcaacatatgactgtccgcccgccatagcaggcaacaagccaatggcaaacttgattttttctgg

SEQ ID NO: 709 - DNA, 200 bp, Amaranthus viridis
ccgatgaactttcaatgcagtgcatcttgattgctctgaaccgattcctgcaggagaaacatggttctaagatggccttcctagacggaaaccctccagagaggctgtgcatgcctattgttaagcacattgagtcactaggtggtgaagttaaacttaattctcgtatacaaaagattcagttggatcagagtggaagc

SEQ ID NO: 710 - DNA, 200 bp, Amaranthus viridis
gcttccactctgatccaactgaatcttttgtatacgagaattaagtttaacttcaccacctagtgactcaatgtgcttaacaataggcatgcacagcctctctggagggtttccgtctaggaaggccatcttagaaccatgtttctcctgcaggaatcggttcagagcaatcaagatgcactgcattgaaagttcatcgg

SEQ ID NO: 711 - DNA, 200 bp, Amaranthus viridis
gattcagttggatcagagtggaagcgtgaagagttttttgctaaataacgggagggaaatacgaggagatgcctatgtttttgccaccccagttgacattttgaagctgttactacccgatacttggaaggaaatctcatacttcaaaaagcttgagaaattagtgggcgttcctgtgattaatgttcacatatggtttg

SEQ ID NO: 712 - DNA, 200 bp, Amaranthus viridis
caaaccatatgtgaacattaatcacaggaacgcccactaatttctcaagctttttgaagtatgagatttccttccaagtatcgggtagtaacagcttcaaaatgtcaactggggtggcaaaaacataggcatctcctcgtatttccctcccgttatttagcaaaaaactcttcacgcttccactctgatccaactgaatc

SEQ ID NO: 713 - DNA, 200 bp, Amaranthus viridis
gtgattaatgttcacatatggtttgacagaaaattaaagaatacatatgaccatctactcttcagcaggagtcctcttttgagtgtctacgctgatatgtcggagacatgcaaggaatataaggatcctaatagatccatgctggaactggtttttgcacccgcggaggaatggatttcacgaagcgacactgatattat

SEQ ID NO: 714 - DNA, 200 bp, Amaranthus viridis
ataatatcagtgtcgcttcgtgaaatccattcctccgcgggtgcaaaaaccagttccagcatggatctattaggatccttatattccttgcatgtctccgacatatcagcgtagacactcaaaagaggactcctgctgaagagtagatggtcatatgtattctttaattttctgtcaaaccatatgtgaacattaatcac

SEQ ID NO: 715 - DNA, 200 bp, Amaranthus viridis
tttcacgaagcgacactgatattatcgaggcaacaatgaaagagcttgccaagcttttcccggatgaaatcgctgccgatggaagcaaggccaagatccttaagtatcatgttgtgaaaacaccaaggtcggtttataagactgtaccggattgtgaaccttgtcggccgctgcaaagatcaccaatagagggtttctat

SEQ ID NO: 716 - DNA, 200 bp, Amaranthus viridis
atagaaaccctctattggtgatctttgcagcggccgacaaggttcacaatccggtacagtcttataaaccgaccttggtgttttcacaacatgatacttaaggatcttggccttgcttccatcggcagcgatttcatccgggaaaagcttggcaagctctttcattgttgcctcgataatatcagtgtcgcttcgtgaaa

SEQ ID NO: 717 - DNA, 200 bp, Amaranthus viridis
aagatcaccaatagagggtttctatttagctggtgattacacaaaacaaaaatatttggcttctatggaaggtgctgtcttatctgggaagctttgtgcacaggctatcgtacaggattatgatctgctgagttctcgagcacaaagagaattggcggcgacaagcaatgtataaccctaaattgcttcgacatccgcca

SEQ ID NO: 718 - DNA, 200 bp, Amaranthus viridis
tggcggatgtcgaagcaatttagggttatacattgcttgtcgccgccaattctctttgtgctcgagaactcagcagatcataatcctgtacgatagcctgtgcacaaagcttcccagataagacagcaccttccatagaagccaaatatttttgttttgtgtaatcaccagctaaatagaaaccctctattggtgatctt

SEQ ID NO: 719 - DNA, 200 bp, Amaranthus viridis
ccctaaattgcttcgacatccgccatcgactttcattcgagatctggattgggaatctgatcatcgaataatgatcagctgtaaagaaaattgtgggggttgcatactggtgctgttcaagttcttgatgtacaaattctcctgaaagaagatttatttgtaatgatatatcaattgatagaaatatgtatagcttactt

SEQ ID NO: 720 - DNA, 200 bp, Amaranthus viridis
aagtaagctatacatatttctatcaattgatatatcattacaaataaatcttctttcaggagaatttgtacatcaagaacttgaacagcaccagtatgcaacccccacaattttctttacagctgatcattattcgatgatcagattcccaatccagatctcgaatgaaagtcgatggcggatgtcgaagcaatttaggg

SEQ ID NO: 721 - DNA, 200 bp, Ambrosia artemisiifolia
atccatacgctcaggtaatctatcttcacttaatccttagggtttatatttcctgcttaagaaggtgagtttatgttacaatgctttgctttattttaactttatgtgttcgatttcatgttaaatcttcacatgttaattgattaggattatttttattcttttttatttgaattagcgttaaaatcatttatggattt

SEQ ID NO: 722 - DNA, 200 bp, Ambrosia artemisiifolia
aaatccataaatgattttaacgctaattcaaataaaaaagaataaaaataatcctaatcaattaacatgtgaagatttaacatgaaatcgaacacataaagttaaaataaagcaaagcattgtaacataaactcaccttcttaagcaggaaatataaaccctaaggattaagtgaagatagattacctgagcgtatggat

SEQ ID NO: 723 - DNA, 200 bp, Ambrosia artemisiifolia
tagcgttaaaatcatttatggattttttatttgaaccatttattgtgtggacttccatttctataattatcattcaaatagtaagaaaaaggaatgaaaagtctagctttattttgatatatatattttttatcatttctgtagggcataccagatcgagttactactgaggtgtttattgccatgtcaaaggcattaaa

SEQ ID NO: 724 - DNA, 200 bp, Ambrosia artemisiifolia
tttaatgcctttgacatggcaataaacacctcagtagtaactcgatctggtatgccctacagaaatgataaaaaatatatatatcaaaataaagctagacttttcattcctttttcttactatttgaatgataattatagaaatggaagtccacacaataaatggttcaaataaaaaatccataaatgattttaacgcta

SEQ ID NO: 725 - DNA, 200 bp, Ambrosia artemisiifolia
ttattgccatgtcaaaggcattaaacttcatcaatccagatgaactttcaatgcagtgcattctcattgctctcaaccgctttcttcaggtaaactcatttattataccttgacgcttattgatttaagtattttggaataaactaatatcactacaatttagtttcatttatgttttctgtatataaaagatgagtcat

SEQ ID NO: 726 - DNA, 200 bp, Ambrosia artemisiifolia
atgactcatcttttatatacagaaaacataaatgaaactaaattgtagtgatattagtttattccaaaatacttaaatcaataagcgtcaaggtataataaatgagtttacctgaagaaagcggttgagagcaatgagaatgcactgcattgaaagttcatctggattgatgaagtttaatgcctttgacatggcaataa

SEQ ID NO: 727 - DNA, 200 bp, Ambrosia artemisiifolia
tttctgtatataaaagatgagtcataaatcattattgttgttgtctaaagacactgcaactcctgactgtattttcagttattgactggtataaaatgaatcaacaggaaaagcatggctctaagatggcatttttagatggcagcccacctgaaagactttgcatgccaattgttgaccatattgaatcactaggtggc

SEQ ID NO: 728 - DNA, 200 bp, Ambrosia artemisiifolia
gccacctagtgattcaatatggtcaacaattggcatgcaaagtctttcaggtgggctgccatctaaaaatgccatcttagagccatgcttttcctgttgattcattttataccagtcaataactgaaaatacagtcaggagttgcagtgtctttagacaacaacaataatgatttatgactcatcttttatatacagaaa

SEQ ID NO: 729 - DNA, 200 bp, Ambrosia artemisiifolia
tgaccatattgaatcactaggtggccaagtcagacttaattcgcggatacaaaagatcgagttaaacaaagatgggactgttaaaaactttttactgaatgatgggactgtcatcaaaggtgatgcttatgtgtttgctactccaggtatgttaattcaaaccactatttggctttgaactttgaagtctccacatatat

SEQ ID NO: 730 - DNA, 200 bp, Ambrosia artemisiifolia
atatatgtggagacttcaaagttcaaagccaaatagtggtttgaattaacatacctggagtagcaaacacataagcatcacctttgatgacagtcccatcattcagtaaaaagtttttaacagtcccatctttgtttaactcgatcttttgtatccgcgaattaagtctgacttggccacctagtgattcaatatggtca

SEQ ID NO: 731 - DNA, 200 bp, Ambrosia artemisiifolia
tgaactttgaagtctccacatatatctctctctggagtgcacaagctttattgtctgttttgtatcaagcagttgacattctgaagcttcttttgcctgaagattggaaaccggttccatacttcaaaaagttggaaaaattagttggtgttccagttataaacgttcatatatggttagatggaccctttcaatataat

SEQ ID NO: 732 - DNA, 200 bp, Ambrosia artemisiifolia
attatattgaaagggtccatctaaccatatatgaacgtttataactggaacaccaactaatttttccaactttttgaagtatggaaccggtttccaatcttcaggcaaaagaagcttcagaatgtcaactgcttgatacaaaacagacaataaagcttgtgcactccagagagagatatatgtggagacttcaaagttca

SEQ ID NO: 733 - DNA, 200 bp, Ambrosia artemisiifolia
gttagatggaccctttcaatataatgctaatccttataacgatagtagttatgccctttcacttgttttattgttaccccaattttctaggtttgtactaggaagctcaaaaacacttatgatcacctacttttcagcaggtcacctcttatttcttgcgtaaacatttaattattttctcacaaagaatgttggctttt

SEQ ID NO: 734 - DNA, 200 bp, Ambrosia artemisiifolia
aaaagccaacattctttgtgagaaaataattaaatgtttacgcaagaaataagaggtgacctgctgaaaagtaggtgatcataagtgtttttgagcttcctagtacaaacctagaaaattggggtaacaataaaacaagtgaaagggcataactactatcgttataaggattagcattatattgaaagggtccatctaac

SEQ ID NO: 735 - DNA, 200 bp, Ambrosia artemisiifolia
caattggactcttgcctgccatgatgggtggacaggctgttgaggctcaagatggacttagtgtccaagattggatgagaaagcaagtatgtaatcatttaacttactttctaccctgctataatcatttaattcaggtaaaacagactgcatatatatatattttttttatcatttctgtagggcataccagatcgagt

SEQ ID NO: 736 - DNA, 200 bp, Ambrosia artemisiifolia
actcgatctggtatgccctacagaaatgataaaaaaaatatatatatatgcagtctgttttacctgaattaaatgattatagcagggtagaaagtaagttaaatgattacatacttgctttctcatccaatcttggacactaagtccatcttgagcctcaacagcctgtccacccatcatggcaggcaagagtccaattg

SEQ ID NO: 737 - DNA, 200 bp, Ambrosia trifida
aaatattaatggttggtgcatatgcgcctcgagtgaaggcaaaggaagcaacaccaacaatgtcaaagtcttatttccaggtaatatgaaaagcaaaggaagcaatcaaaagaaatttcttggacgagctgatgcaaattatcccaacattaaaaaaattttgtatactgccgaacatgtagccatccatcacaaacacg

SEQ ID NO: 738 - DNA, 200 bp, Ambrosia trifida
cgtgtttgtgatggatggctacatgttcggcagtatacaaaatttttttaatgttgggataatttgcatcagctcgtccaagaaatttcttttgattgcttcctttgcttttcatattacctggaaataagactttgacattgttggtgttgcttcctttgccttcactcgaggcgcatatgcaccaaccattaatattt

SEQ ID NO: 739 - DNA, 200 bp, Ambrosia trifida
catgtagccatccatcacaaacacgtagtcctagatcttcatatgtgatcaacctcgtgcaagaataaacttcaaagacaaagaaaaatcaaatgatagaacccaaaataagaggatacgaatttttcatttgattagacaaatgaggaagatccaaatccaacttggacaaagatgaagaatgttatcacccgcacaac

SEQ ID NO: 740 - DNA, 200 bp, Ambrosia trifida
gttgtgcgggtgataacattcttcatctttgtccaagttggatttggatcttcctcatttgtctaatcaaatgaaaaattcgtatcctcttattttgggttctatcatttgatttttctttgtctttgaagtttattcttgcacgaggttgatcacatatgaagatctaggactacgtgtttgtgatggatggctacatg

SEQ ID NO: 741 - DNA, 200 bp, Ambrosia trifida
tgaagaatgttatcacccgcacaactaggggaattcaaggttaagcggattgtggtatgaggtaagaaagaatacaatataggggaattaggaagtaaaggaataagaaaaaaaagaatgatatatagctttaggaaaatctaggagtgaggagaatatagcaaaatatgaggaagttaaaaccaagacgaagcaagcga

SEQ ID NO: 742 - DNA, 200 bp, Ambrosia trifida
tcgcttgcttcgtcttggttttaacttcctcatattttgctatattctcctcactcctagattttcctaaagctatatatcattcttttttttcttattcctttacttcctaattcccctatattgtattctttcttacctcataccacaatccgcttaaccttgaattcccctagttgtgcgggtgataacattcttca

SEQ ID NO: 743 - DNA, 200 bp, Ambrosia trifida
gttaaaaccaagacgaagcaagcgatatgtgagacaaagttaaaagagtattaagagatatacaataagctgactcaagagaagaggataatgatctttgtaggatagcctgaaggagacaaatgattataaaagatactagttgaatgaactatgaagtgtgtcttggataaataacaaaataatattctccaagatga

SEQ ID NO: 744 - DNA, 200 bp, Ambrosia trifida
tcatcttggagaatattattttgttatttatccaagacacacttcatagttcattcaactagtatcttttataatcatttgtctccttcaggctatcctacaaagatcattatcctcttctcttgagtcagcttattgtatatctcttaatactcttttaactttgtctcacatatcgcttgcttcgtcttggttttaac

SEQ ID NO: 745 - DNA, 200 bp, Ambrosia trifida
aacaaaataatattctccaagatgaatagatatacgataaatggaaggagttttttgacgagttgtgcaatggatgtcaaggggcacgatagaatacatcttgaaggaattctgaaaaggtgcttttctaggaatgtaaattgtgagaaaaggaagaaggcgatcatcggtaaatcaattgtctttgctcacaaaatgtg

SEQ ID NO: 746 - DNA, 200 bp, Ambrosia trifida
cacattttgtgagcaaagacaattgatttaccgatgatcgccttcttccttttctcacaatttacattcctagaaaagcaccttttcagaattccttcaagatgtattctatcgtgccccttgacatccattgcacaactcgtcaaaaaactccttccatttatcgtatatctattcatcttggagaatattattttgtt

SEQ ID NO: 747 - DNA, 200 bp, Ambrosia trifida
caattgtctttgctcacaaaatgtgacaccaacatgttggatgggggagagaagttttcaatgttaactactctttcggttatgtacgtaagtatgtttttttatgaggcatcttgttcaagagctcatcattaatatagaggagcaaaaacttacagataccatcttatggaccaagcatatattgttcacaaatagat

SEQ ID NO: 748 - DNA, 200 bp, Ambrosia trifida
atctatttgtgaacaatatatgcttggtccataagatggtatctgtaagtttttgctcctctatattaatgatgagctcttgaacaagatgcctcataaaaaaacatacttacgtacataaccgaaagagtagttaacattgaaaacttctctcccccatccaacatgttggtgtcacattttgtgagcaaagacaattg

SEQ ID NO: 749 - DNA, 200 bp, Ambrosia trifida
aagcatatattgttcacaaatagattcaaaaccttttatatcttcaaatatgaatgtgagaaatgacttctcttactttttttacttccaggtttggctggtctatccacggcaaagtatttagctgatgcaggtcataagccccttttgcttgaagcaagagacgttcttggtggaaaggttgcggcttggaaagatga

SEQ ID NO: 750 - DNA, 200 bp, Ambrosia trifida
tcatctttccaagccgcaacctttccaccaagaacgtctcttgcttcaagcaaaaggggcttatgacctgcatcagctaaatactttgccgtggatagaccagccaaacctggaagtaaaaaaagtaagagaagtcatttctcacattcatatttgaagatataaaaggttttgaatctatttgtgaacaatatatgctt

SEQ ID NO: 751 - DNA, 200 bp, Ambrosia trifida
gaaaggttgcggcttggaaagatgatgacggagattggtacgagacaggcttacacattttctgtaagtttttactttactcaactaactaactaataatggatggaaaatcagctgctttaactaactctttcctttgcttcacagttggagcttacccaaatgtacagaacctctttggagagttagggattaatgat

SEQ ID NO: 752 - DNA, 200 bp, Ambrosia trifida
atcattaatccctaactctccaaagaggttctgtacatttgggtaagctccaactgtgaagcaaaggaaagagttagttaaagcagctgattttccatccattattagttagttagttgagtaaagtaaaaacttacagaaaatgtgtaagcctgtctcgtaccaatctccgtcatcatctttccaagccgcaacctttc

SEQ ID NO: 753 - DNA, 200 bp, Ambrosia trifida
ctttggagagttagggattaatgatagactacaatggaaggagcattctatgatttttgcaatgccaaacaagcctggtgaatttagtcgcttcgacttcccagatgttttgcctgcaccactaaatggcaagttatctactaactacaactacctcagaccgaccgaccactactatgaatcttatctttctaatttgc

SEQ ID NO: 754 - DNA, 200 bp, Ambrosia trifida
gcaaattagaaagataagattcatagtagtggtcggtcggtctgaggtagttgtagttagtagataacttgccatttagtggtgcaggcaaaacatctgggaagtcgaagcgactaaattcaccaggcttgtttggcattgcaaaaatcatagaatgctccttccattgtagtctatcattaatccctaactctccaaag

SEQ ID NO: 755 - DNA, 200 bp, Ambrosia trifida
tatgaatcttatctttctaatttgcatcctattataggaatttgggctatcttgaggaacaatgaaatgttgacatggcccgagaaagtcaaattcgcaatcggactcttgcctgcaatgttgggtggacaagcttatgttgaggctcaagatggacttagtgttcaagattggatgagaaagcaagtatgtagtcattt

SEQ ID NO: 756 - DNA, 200 bp, Ambrosia trifida
aaatgactacatacttgctttctcatccaatcttgaacactaagtccatcttgagcctcaacataagcttgtccacccaacattgcaggcaagagtccgattgcgaatttgactttctcgggccatgtcaacatttcattgttcctcaagatagcccaaattcctataataggatgcaaattagaaagataagattcata

SEQ ID NO: 757 - DNA, 200 bp, Ambrosia trifida
tgagaaagcaagtatgtagtcatttaagtttttttatcatttctgtagggcataccagatcgagttactactgaggtttttattgccatgtcaaaggcattaaacttcatcaatccagatgaactttcaatgcaatgcattctcattgctctgaaccgctttcttcaggtaaacattttctttcaattattgaccgctgt

SEQ ID NO: 758 - DNA, 200 bp, Ambrosia trifida
acagcggtcaataattgaaagaaaatgtttacctgaagaaagcggttcagagcaatgagaatgcattgcattgaaagttcatctggattgatgaagtttaatgcctttgacatggcaataaaaacctcagtagtaactcgatctggtatgccctacagaaatgataaaaaaacttaaatgactacatacttgctttctca

SEQ ID NO: 759 - DNA, 200 bp, Ambrosia trifida
ttttctttcaattattgaccgctgtacaatgaatcaataggaaaagcatggctctaagatggcatttttagatggcagcccacctgaaagactttgcatgccaattgttgaccatattgaatcactaggtggccaagtcagacttaattcacggatacaaaagattgagttaaacaaagatggaactgttaaaaactttt

SEQ ID NO: 760 - DNA, 200 bp, Ambrosia trifida
aaaagtttttaacagttccatctttgtttaactcaatcttttgtatccgtgaattaagtctgacttggccacctagtgattcaatatggtcaacaattggcatgcaaagtctttcaggtgggctgccatctaaaaatgccatcttagagccatgcttttcctattgattcattgtacagcggtcaataattgaaagaaaa

SEQ ID NO: 761 - DNA, 200 bp, Ambrosia trifida
aaagatggaactgttaaaaactttttactcaatgacgggactatcatcaaaggtgatgcttatgtgtttgctactccaggtatgttaattaaaccgccatttgcctgaagtctccacatatttctctctgggggccacaagctttactttactggctgttttgtatcaagcagttgacattctgaagcttcttttgcctg

SEQ ID NO: 762 - DNA, 200 bp, Ambrosia trifida
caggcaaaagaagcttcagaatgtcaactgcttgatacaaaacagccagtaaagtaaagcttgtggcccccagagagaaatatgtggagacttcaggcaaatggcggtttaattaacatacctggagtagcaaacacataagcatcacctttgatgatagtcccgtcattgagtaaaaagtttttaacagttccatcttt

SEQ ID NO: 763 - DNA, 200 bp, Ambrosia trifida
acttgtatggcaattgacatgttaactacattaccttttttaccccacagacgaaagactgttaaacaagttgctcatattattcaggaatattatgatccaaatcggtcaatgttggaattggtttttgcacccgcagaagaatggattgcacgcagcgactctgacattattgatgccaccatgagtgaactttcaag

SEQ ID NO: 764 - DNA, 200 bp, Ambrosia trifida
cttgaaagttcactcatggtggcatcaataatgtcagagtcgctgcgtgcaatccattcttctgcgggtgcaaaaaccaattccaacattgaccgatttggatcataatattcctgaataatatgagcaacttgtttaacagtctttcgtctgtggggtaaaaaaggtaatgtagttaacatgtcaattgccatacaagt

SEQ ID NO: 765 - DNA, 200 bp, Ambrosia trifida
atgccaccatgagtgaactttcaagactctttcctgatgaaattgcagcagatgggagcaaagcaaaaatattgaaatatcatgtagtaaaaacaccaaggctagtattcacatgtgcaaaccgaagacaaatttgtttattctgatgaagtattaattaattattgggttgtggtgcttcaggtcggtttataaactgt

SEQ ID NO: 766 - DNA, 200 bp, Ambrosia trifida
acagtttataaaccgacctgaagcaccacaacccaataattaattaatacttcatcagaataaacaaatttgtcttcggtttgcacatgtgaatactagccttggtgtttttactacatgatatttcaatatttttgctttgctcccatctgctgcaatttcatcaggaaagagtcttgaaagttcactcatggtggcat

SEQ ID NO: 767 - DNA, 200 bp, Ambrosia trifida
tgcttcaggtcggtttataaactgtgccagactgtgaaccttgccgtcccttgcaaagatctccaatagaaggattttatttagctggtgattacacgaacaaaagtatttggcttcaatggagggtgctgttttgtcaggaaaattttgtgcccaggctattgtacaggtaataaataattgagtaagcataaaacaca

SEQ ID NO: 768 - DNA, 200 bp, Ambrosia trifida
tgtgttttatgcttactcaattatttattacctgtacaatagcctgggcacaaaattttcctgacaaaacagcaccctccattgaagccaaatacttttgttcgtgtaatcaccagctaaataaaatccttctattggagatctttgcaagggacggcaaggttcacagtctggcacagtttataaaccgacctgaagca

SEQ ID NO: 769 - DNA, 200 bp, Ambrosia trifida
aataattgagtaagcataaaacacaaacaaggcgagattttgtgtgatctcatgcatcatcttgttatgttacacaggattacgagttgcttgctgcgaggggggaggtgatggctgaagcaagcctggtctaagatgacgtggcaagttgaaaagtaaaaaagccaacattttttatgagaaaataattaactgttttg

SEQ ID NO: 770 - DNA, 200 bp, Ambrosia trifida
caaaacagttaattattttctcataaaaaatgttggcttttttacttttcaacttgccacgtcatcttagaccaggcttgcttcagccatcacctcccccctcgcagcaagcaactcgtaatcctgtgtaacataacaagatgatgcatgagatcacacaaaatctcgccttgtttgtgttttatgcttactcaattatt

SEQ ID NO: 771 - DNA, 200 bp, Ambrosia trifida
tatgagaaaataattaactgttttgcaagaagtaagagatgacgacctgctgaaaagtaggtgatcataagtgtttttgagcttcctgtcaaacctgaaaattggctgaattattattaccttataaggaaggattagcattatattgaaagggtcggtccatctaaccaaccatatatgaacgtttataactggaacac

SEQ ID NO: 772 - DNA, 200 bp, Ambrosia trifida
gtgttccagttataaacgttcatatatggttggttagatggaccgaccctttcaatataatgctaatccttccttataaggtaataataattcagccaattttcaggtttgacaggaagctcaaaaacacttatgatcacctacttttcagcaggtcgtcatctcttacttcttgcaaaacagttaattattttctcata

SEQ ID NO: 773 - DNA, 200 bp, Ambrosia trifida
atatgaacgtttataactggaacaccaactaatttttccaactttttgaagtatggaaccggtttccaatcttcaggcaaaagaagcttcagaatgtcaactgcttgatacaacacagccagtaaagtaaagcttgtggcccccagagagaaatatgtggagacttcagccaaatggcggtttaattaacatacctggag

SEQ ID NO: 774 - DNA, 200 bp, Ambrosia trifida
ctccaggtatgttaattaaaccgccatttggctgaagtctccacatatttctctctgggggccacaagctttactttactggctgtgttgtatcaagcagttgacattctgaagcttcttttgcctgaagattggaaaccggttccatacttcaaaaagttggaaaaattagttggtgttccagttataaacgttcatat

SEQ ID NO: 775 - DNA, 200 bp, Ambrosia trifida
ggcggtttaattaacatacctggagtagcaaacacataagcatcacctttgatgatagtcccgtcattgagtaaaaagtttttaacagttccatctttgtttaactcaatcttttgtatccgtgaattaagtctgacttggccacctagtgattcaatatggtcaacaattggcatgcaaagtctttcaggtgggctgcc

SEQ ID NO: 776 - DNA, 200 bp, Ambrosia trifida
ggcagcccacctgaaagactttgcatgccaattgttgaccatattgaatcactaggtggccaagtcagacttaattcacggatacaaaagattgagttaaacaaagatggaactgttaaaaactttttactcaatgacgggactatcatcaaaggtgatgcttatgtgtttgctactccaggtatgttaattaaaccgcc

SEQ ID NO: 777 - DNA, 200 bp, Ambrosia trifida
tgcaaagtctttcaggtgggctgccatctaaaaatgccatcttagagccatgcttttcctattgattcattgtacagcggtcaataattgaaagaaaatacagtcgcgagttgcagtgtctttagacaacaacaataatgagccatctttttcttttatatacataaaacataaatgaaactaaactcttgtgacattaa

SEQ ID NO: 778 - DNA, 200 bp, Ambrosia trifida
ttaatgtcacaagagtttagtttcatttatgttttatgtatataaaagaaaaagatggctcattattgttgttgtctaaagacactgcaactcgcgactgtattttctttcaattattgaccgctgtacaatgaatcaataggaaaagcatggctctaagatggcatttttagatggcagcccacctgaaagactttgca

SEQ ID NO: 779 - DNA, 200 bp, Ambrosia trifida
tgaaactaaactcttgtgacattaatttattccaaattacttaatcagtagtaagcttgaagataataataataataataatgagtttacctgaagaaagcggttcagagcaatgagaatgcattgcattgaaagttcatctggattgatgaagtttaatgcctttgacatggcaataaaacctcagtagtaactcgatc

SEQ ID NO: 780 - DNA, 200 bp, Ambrosia trifida
gatcgagttactactgaggttttattgccatgtcaaaggcattaaacttcatcaatccagatgaactttcaatgcaatgcattctcattgctctgaaccgctttcttcaggtaaactcattattattattattattatcttcaagcttactactgattaagtaatttggaataaattaatgtcacaagagtttagtttca

SEQ ID NO: 781 - DNA, 200 bp, Ambrosia trifida
ataaaacctcagtagtaactcgatctggtatgccctacagaaatgataaaaatatatatatatgcagctgttttacttaaaaatcaacttatagcaacttaaatgactacatacttgctttctcatccaatcttgaacactaagtccatcttgagcctcaacataagcttgtccacccaacattgcaggcaagagtccga

SEQ ID NO: 782 - DNA, 200 bp, Ambrosia trifida
tcggactcttgcctgcaatgttgggtggacaagcttatgttgaggctcaagatggacttagtgttcaagattggatgagaaagcaagtatgtagtcatttaagttgctataagttgatttttaagtaaaacagctgcatatatatatatttttatcatttctgtagggcataccagatcgagttactactgaggttttat

SEQ ID NO: 783 - DNA, 200 bp, Ambrosia trifida
cccaacattgcaggcaagagtccgattgcgaatttgactttctcgggccatgtcaacatttcattgttcctcaagatagcccaaattcctataataggatgcaaattagaaagataagattcatagtagtggtcggtctgaggtagttgtagttagtagataacttgccatttagtggtgcaggcaaaacatctgggaag

SEQ ID NO: 784 - DNA, 200 bp, Ambrosia trifida
cttcccagatgttttgcctgcaccactaaatggcaagttatctactaactacaactacctcagaccgaccactactatgaatcttatctttctaatttgcatcctattataggaatttgggctatcttgaggaacaatgaaatgttgacatggcccgagaaagtcaaattcgcaatcggactcttgcctgcaatgttggg

SEQ ID NO: 785 - DNA, 200 bp, Ambrosia trifida
tggtgcaggcaaaacatctgggaagtcgaagcgactaaattcaccaggcttgtttggcattgcaaaaatcatagaatgctccttccattgtagtctatcattaatccctaactctccaaagaggttctgtacatttgggtaagctccaactgtgaagcaaagggaagagttagttaaagcagctgattttccatccatta

SEQ ID NO: 786 - DNA, 200 bp, Ambrosia trifida
taatggatggaaaatcagctgctttaactaactcttccctttgcttcacagttggagcttacccaaatgtacagaacctctttggagagttagggattaatgatagactacaatggaaggagcattctatgatttttgcaatgccaaacaagcctggtgaatttagtcgcttcgacttcccagatgttttgcctgcacca

SEQ ID NO: 787 - DNA, 200 bp, Ambrosia trifida
aaagcagctgattttccatccattattagttagttagttgagtaaagtaaaaacttacagaaaatgtgtaagcctgtctcgtaccaatctccgtcatcatctttccaagccgcaacctttccaccaagaacgtctcttgcttcaagcaaaaggggcttatgaccggcatcagccaaatacttagcagtggatagaccagc

SEQ ID NO: 788 - DNA, 200 bp, Ambrosia trifida
gctggtctatccactgctaagtatttggctgatgccggtcataagccccttttgcttgaagcaagagacgttcttggtggaaaggttgcggcttggaaagatgatgacggagattggtacgagacaggcttacacattttctgtaagtttttactttactcaactaactaactaataatggatggaaaatcagctgcttt

SEQ ID NO: 789 - DNA, 200 bp, Ambrosia trifida
attcgaaacaagggccgaccaagttccaacaacgaaacaagccaaaaaccgttccaaccaactactactacttcatcttcttaatcatcatcatcttctcctcctcttttaaattaataaaaattagagcagcagcagcagcagcagcagcaattgagttgatcgagtctcttaggtcatgtctctggttggaaattctg

SEQ ID NO: 790 - DNA, 200 bp, Ambrosia trifida
cagaatttccaaccagagacatgacctaagagactcgatcaactcaattgctgctgctgctgctgctgctgctctaatttttattaatttaaaagaggaggagaagatgatgatgattaagaagatgaagtagtagtagttggttggaacggtttttggcttgtttcgttgttggaacttggtcggcccttgtttcgaat

SEQ ID NO: 791 - DNA, 200 bp, Ambrosia trifida
gtcatgtctctggttggaaattctgtagtaacgagtcatgtattgtcgtttagtcaggcgggtgctcatcgactgaaattcccggctgtccgattaagaaccaacaacactgtctactgccctttcaaggtggtctgcgtcgactatccaagaccagaccttgacaacacttctaacttcttagaggctgcctacttgtc

SEQ ID NO: 792 - DNA, 200 bp, Ambrosia trifida
gacaagtaggcagcctctaagaagttagaagtgttgtcaaggtctggtcttggatagtcgacgcagaccaccttgaaagggcagtagacagtgttgttggttcttaatcggacagccgggaatttcagtcgatgagcacccgcctgactaaacgacaatacatgactcgttactacagaatttccaaccagagacatgac

SEQ ID NO: 793 - DNA, 200 bp, Ambrosia trifida
acttcttagaggctgcctacttgtcttctaccttccgagcttcccctcgtccagctaagcccttaaacgttgttattgctggtgcaggtttggctggtctatccactgctaagtatttggctgatgccggtcataagccccttttgcttgaagcaagagacgttcttggtggaaaggttgcggcttggaaagatgatgac

SEQ ID NO: 794 - DNA, 200 bp, Ambrosia trifida
gtcatcatctttccaagccgcaacctttccaccaagaacgtctcttgcttcaagcaaaaggggcttatgaccggcatcagccaaatacttagcagtggatagaccagccaaacctgcaccagcaataacaacgtttaagggcttagctggacgaggggaagctcggaaggtagaagacaagtaggcagcctctaagaagt

SEQ ID NO: 795 - DNA, 200 bp, Ambrosia trifida
ggttgcggcttggaaagatgatgacggagattggtacgagacaggcttacacattttctttggagcttacccaaatgtacagaacctctttggagagttagggattaatgatagactacaatggaaggagcattctatgatttttgcaatgccaaacaagcctggtgaatttagtcgcttcgacttcccagatgttttgc

SEQ ID NO: 796 - DNA, 200 bp, Ambrosia trifida
gcaaaacatctgggaagtcgaagcgactaaattcaccaggcttgtttggcattgcaaaaatcatagaatgctccttccattgtagtctatcattaatccctaactctccaaagaggttctgtacatttgggtaagctccaaagaaaatgtgtaagcctgtctcgtaccaatctccgtcatcatctttccaagccgcaacc

SEQ ID NO: 797 - DNA, 200 bp, Ambrosia trifida
cgcttcgacttcccagatgttttgcctgcaccactaaatggaatttgggctatcttgaggaacaatgaaatgttgacatggcccgagaaagtcaaattcgcaatcggactcttgcctgcaatgttgggtggacaagcttatgttgaggctcaagatggacttagtgttcaagattggatgagaaagcaaggcataccaga

SEQ ID NO: 798 - DNA, 200 bp, Ambrosia trifida
tctggtatgccttgctttctcatccaatcttgaacactaagtccatcttgagcctcaacataagcttgtccacccaacattgcaggcaagagtccgattgcgaatttgactttctcgggccatgtcaacatttcattgttcctcaagatagcccaaattccatttagtggtgcaggcaaaacatctgggaagtcgaagcg

SEQ ID NO: 799 - DNA, 200 bp, Ambrosia trifida
ggatgagaaagcaaggcataccagatcgagttactactgaggtttttattgccatgtcaaaggcattaaacttcatcaatccagatgaactttcaatgcaatgcattctcattgctctgaaccgctttcttcaggaaaagcatggctctaagatggcatttttagatggcagcccacctgaaagactttgcatgccaatt

SEQ ID NO: 800 - DNA, 200 bp, Ambrosia trifida
aattggcatgcaaagtctttcaggtgggctgccatctaaaaatgccatcttagagccatgcttttcctgaagaaagcggttcagagcaatgagaatgcattgcattgaaagttcatctggattgatgaagtttaatgcctttgacatggcaataaaaacctcagtagtaactcgatctggtatgccttgctttctcatcc

SEQ ID NO: 801 - DNA, 200 bp, Ambrosia trifida
acctgaaagactttgcatgccaattgttgaccatattgaatcactaggtggccaagtcagacttaattcacggatacaaaagattgagttaaacaaagatggaactgttaaaaactttttactcaatgacgggactatcatcaaaggtgatgcttatgtgtttgctactccagttgacattctgaagcttcttttgcctg

SEQ ID NO: 802 - DNA, 200 bp, Ambrosia trifida
caggcaaaagaagcttcagaatgtcaactggagtagcaaacacataagcatcacctttgatgatagtcccgtcattgagtaaaaagtttttaacagttccatctttgtttaactcaatcttttgtatccgtgaattaagtctgacttggccacctagtgattcaatatggtcaacaattggcatgcaaagtctttcaggt

SEQ ID NO: 803 - DNA, 200 bp, Ambrosia trifida
gacattctgaagcttcttttgcctgaagattggaaaccggttccatacttcaaaaagttggaaaaattagttggtgttccagttataaacgttcatatatggtttgacaggaagctcaaaaacacttatgatcacctacttttcagcagaagccctcttcttagtgtatatgctgacatgtctgttacatgtaaggaata

SEQ ID NO: 804 - DNA, 200 bp, Ambrosia trifida
tattccttacatgtaacagacatgtcagcatatacactaagaagagggcttctgctgaaaagtaggtgatcataagtgtttttgagcttcctgtcaaaccatatatgaacgtttataactggaacaccaactaatttttccaactttttgaagtatggaaccggtttccaatcttcaggcaaaagaagcttcagaatgtc

SEQ ID NO: 805 - DNA, 200 bp, Ambrosia trifida
acatgtctgttacatgtaaggaatattatgatccaaatcggtcaatgttggaattggtttttgcacccgcagaagaatggattgcacgcagcgactctgacattattgatgccaccatgagtgaactttcaagactctttcctgatgaaattgcagcagatgggagcaaagcaaaaatattgaaatatcatgtagtaaaa

SEQ ID NO: 806 - DNA, 200 bp, Ambrosia trifida
ttttactacatgatatttcaatatttttgctttgctcccatctgctgcaatttcatcaggaaagagtcttgaaagttcactcatggtggcatcaataatgtcagagtcgctgcgtgcaatccattcttctgcgggtgcaaaaaccaattccaacattgaccgatttggatcataatattccttacatgtaacagacatgt

SEQ ID NO: 807 - DNA, 200 bp, Ambrosia trifida
aatattgaaatatcatgtagtaaaaacaccaaggtcggtttataaaactgtgccagactgtgaaccttgccgtcccttgcaaagatctccaatagaaggattttatttagctggtgattacacgaaacaaaagtatttggcttcaatggagggtgctgttttgtcaggaaaattttgtgcccaggctattgtacaggatt

SEQ ID NO: 808 - DNA, 200 bp, Ambrosia trifida
aatcctgtacaatagcctgggcacaaaattttcctgacaaaacagcaccctccattgaagccaaatacttttgtttcgtgtaatcaccagctaaataaaatccttctattggagatctttgcaagggacggcaaggttcacagtctggcacagttttataaaccgaccttggtgtttttactacatgatatttcaatatt

SEQ ID NO: 809 - DNA, 200 bp, Ambrosia trifida
tgtgcccaggctattgtacaggattacgagttgcttgctgcgaggggggaggtgatggctgaagcaagcctggtctaagatgacgtggcaagttgaaaattgataaaacacccatccatccatagaacttatcttgtatctgttactttatacatgcattgattaatcagtatttgaaatagcaattgcttgtgaaaaag

SEQ ID NO: 810 - DNA, 200 bp, Ambrosia trifida
ctttttcacaagcaattgctatttcaaatactgattaatcaatgcatgtataaagtaacagatacaagataagttctatggatggatgggtgttttatcaattttcaacttgccacgtcatcttagaccaggcttgcttcagccatcacctcccccctcgcagcaagcaactcgtaatcctgtacaatagcctgggcaca

SEQ ID NO: 811 - DNA, 200 bp, Ambrosia trifida
caacgaaacaagccaaaaaccgttccaaccaactactactacttcatcttcttaatcatcatcatcttctcctcttttaaattaaataaaaattgagcagcagcagcagcagcaattgagttgatcgagtctcttaggtcatgtctctggttggaaattctgtagtaacgagtcatgtattgtcgtttagtcaggcgggt

SEQ ID NO: 812 - DNA, 200 bp, Ambrosia trifida
acccgcctgactaaacgacaatacatgactcgttactacagaatttccaaccagagacatgacctaagagactcgatcaactcaattgctgctgctgctgctgctcaatttttatttaatttaaaagaggagaagatgatgatgattaagaagatgaagtagtagtagttggttggaacggtttttggcttgtttcgttg

SEQ ID NO: 813 - DNA, 200 bp, Ambrosia trifida
tgtattgtcgtttagtcaggcgggtgctcatcgactgaaattcccggctgtccgattaagaaccaacaacactgtctactgccctttcaaggttattttcttcttcttcttctgtctgtaattctgtatatataatatggtaatggtaatttcccccctcccctcccctctcttattgcttattctattctatttatgtg

SEQ ID NO: 814 - DNA, 200 bp, Ambrosia trifida
cacataaatagaatagaataagcaataagagaggggaggggaggggggaaattaccattaccatattatatatacagaattacagacagaagaagaagaagaaaataaccttgaaagggcagtagacagtgttgttggttcttaatcggacagccgggaatttcagtcgatgagcacccgcctgactaaacgacaataca

SEQ ID NO: 815 - DNA, 200 bp, Ambrosia trifida
gtcatctcttacttcttgcaaaacagttaattattttctcataaaaaatgttggcttttttacttttcaacatgtcacctcttatcattgcattgctgctactgtcgatttatatttttcttccatcttttccagaagccctcttcttagtgtatatgctgacatgtctgttacatgtaaggtaatacttgtatggcaat

SEQ ID NO: 816 - DNA, 200 bp, Ambrosia trifida
attgccatacaagtattaccttacatgtaacagacatgtcagcatatacactaagaagagggcttctggaaaagatggaagaaaaatataaatcgacagtagcagcaatgcaatgataagaggtgacatgttgaaaagtaaaaaagccaacattttttatgagaaaataattaactgttttgcaagaagtaagagatgac

SEQ ID NO: 817 - DNA, 200 bp, Ambrosia trifida
tgtaaggtaatacttgtatggcaattgacatgttaactacattaccttttttaacccacagacgaaagactgttaaacaagttgctcatattattcaggaatattatgatccaaatcggtcaatgttggaattggtttttgcacccgcagaagaatggattgcacgcagtgactctgaaattattgatgccaccatgagt

SEQ ID NO: 818 - DNA, 200 bp, Ambrosia trifida
actcatggtggcatcaataatttcagagtcactgcgtgcaatccattcttctgcgggtgcaaaaaccaattccaacattgaccgatttggatcataatattcctgaataatatgagcaacttgtttaacagtctttcgtctgtgggttaaaaaaggtaatgtagttaacatgtcaattgccatacaagtattaccttaca

SEQ ID NO: 819 - DNA, 200 bp, Ambrosia trifida
tgaaattattgatgccaccatgagtgaacttgccaagactctttcctgatgaaattgcagcagatgggagcaaagcaaaaatattgaaatatcatgtcgtcaaaactccaaggtgatcgataaacttgtgaaattaaaatcggataatatcatgctactgctagaaacagcattaatgttgtgcccgcgggctcttttat

SEQ ID NO: 820 - DNA, 200 bp, Ambrosia trifida
ataaaagagcccgcgggcacaacattaatgctgtttctagcagtagcatgatattatccgattttaatttcacaagtttatcgatcaccttggagttttgacgacatgatatttcaatatttttgctttgctcccatctgctgcaatttcatcaggaaagagtcttggcaagttcactcatggtggcatcaataatttca

SEQ ID NO: 821 - DNA, 200 bp, Ambrosia trifida
atgttgtgcccgcgggctcttttataggtcggtttataagacagtgccggattgtgaaccttgtcggccgctgcaaagatcaccgatagagggtttctatttagctggtgattacacaaaacaaaaatatttggcttcaatggaaggtgctgttttatctgggaagctttgtgctcaggctattgtacaggtaataaata

SEQ ID NO: 822 - DNA, 200 bp, Ambrosia trifida
tatttattacctgtacaatagcctgagcacaaagcttcccagataaaacagcaccttccattgaagccaaatatttttgttttgtgtaatcaccagctaaatagaaaccctctatcggtgatctttgcagcggccgacaaggttcacaatccggcactgtcttataaaccgacctataaaagagcccgcgggcacaacat

SEQ ID NO: 823 - DNA, 200 bp, Ambrosia trifida
caggctattgtacaggtaataaataattgagtaagcataaaacacaaacaaggcgagattttgtgtgatctcatgcatcatcttgttatgttacacaggattacgagttgcttgctgcgaggggggaggtgatggctgaagcaagcctggtctaagatgacgtggcaagttgaaaattgataaaaacacccatccatcca

SEQ ID NO: 824 - DNA, 200 bp, Ambrosia trifida
tggatggatgggtgtttttatcaattttcaacttgccacgtcatcttagaccaggcttgcttcagccatcacctcccccctcgcagcaagcaactcgtaatcctgtgtaacataacaagatgatgcatgagatcacacaaaatctcgccttgtttgtgttttatgcttactcaattatttattacctgtacaatagcctg

SEQ ID NO: 825 - DNA, 200 bp, Ambrosia trifida
attgataaaaacacccatccatccatagaacttatcttgtatctgttactttatacatgcattgattaatcagtatttgaaatagcaattgcttgtgaaaaagtttgggtgatgaacacagttttgacttgtttatagtttttttgctaataactagtaaagatgatcgatttaatgagagaagatctactatggtatga

SEQ ID NO: 826 - DNA, 200 bp, Ambrosia trifida
tcataccatagtagatcttctctcattaaatcgatcatctttactagttattagcaaaaaaactataaacaagtcaaaactgtgttcatcacccaaactttttcacaagcaattgctatttcaaatactgattaatcaatgcatgtataaagtaacagatacaagataagttctatggatggatgggtgtttttatcaat

SEQ ID NO: 827 - DNA, 200 bp, Ambrosia trifida
tgagagaagatctactatggtatgacggctttaataaacaacttcagtcctaaccataactaggtatcaaatttatgaataaacatcacagctcacagctaaacattcagctttgatatctatatgaaatctcagatgctttctaattaacttctccaggaccaattggattctttaagtttgtaggagtgtagttgagt

SEQ ID NO: 828 - DNA, 200 bp, Ambrosia trifida
actcaactacactcctacaaacttaaagaatccaattggtcctggagaagttaattagaaagcatctgagatttcatatagatatcaaagctgaatgtttagctgtgagctgtgatgtttattcataaatttgatacctagttatggttaggactgaagttgtttattaaagccgtcataccatagtagatcttctctca

SEQ ID NO: 829 - DNA, 200 bp, Ambrosia trifida
taagtttgtaggagtgtagttgagttggcggttcaaattgatatcccaaccatattagcaggtccacatgtatttatttatatgtttcattttccattcaaacagttgctgttgaaggtactagttaagtctgctgttaaacaagtagattgcagataactttgagcatcatcaagttatatataccgaataggatgctt

SEQ ID NO: 830 - DNA, 200 bp, Ambrosia trifida
aagcatcctattcggtatatataacttgatgatgctcaaagttatctgcaatctacttgtttaacagcagacttaactagtaccttcaacagcaactgtttgaatggaaaatgaaacatataaataaatacatgtggacctgctaatatggttgggatatcaatttgaaccgccaactcaactacactcctacaaactta

SEQ ID NO: 831 - DNA, 200 bp, Ambrosia trifida
gttatatataccgaataggatgcttttgaaagacatgagccggaaaaaacgctatgaggttgatcatacattttgtacgcacgtaaaacacaaatacaaggcaaaataatagtgtctacagacgactgactgattacaggtacactaaccacatctgtatttcaaggctgtgtgtttttatgtttgcccttgtatccgta

SEQ ID NO: 832 - DNA, 200 bp, Ambrosia trifida
tacggatacaagggcaaacataaaaacacacagccttgaaatacagatgtggttagtgtacctgtaatcagtcagtcgtctgtagacactattattttgccttgtatttgtgttttacgtgcgtacaaaatgtatgatcaacctcatagcgttttttccggctcatgtctttcaaaagcatcctattcggtatatataac

SEQ ID NO: 833 - DNA, 200 bp, Ambrosia trifida
ttttatgtttgcccttgtatccgtaaattacggagccaattgaccacttccttaatcgttggccgcttggcggggttaacatttatacacatgcaggcaacatcccttcttgaagcccattgcccgggtcaaatacttgatactgtttcccttcggctctcagttgaagcatccacacaaccagttctcatgaatgcttg

SEQ ID NO: 834 - DNA, 200 bp, Ambrosia trifida
caagcattcatgagaactggttgtgtggatgcttcaactgagagccgaagggaaacagtatcaagtatttgacccgggcaatgggcttcaagaagggatgttgcctgcatgtgtataaatgttaaccccgccaagcggccaacgattaaggaagtggtcaattggctccgtaatttacggatacaagggcaaacataaaa

SEQ ID NO: 835 - DNA, 200 bp, Ambrosia trifida
cacaaccagttctcatgaatgcttggacctgagcctaaatatctctatcttgtaggtagctctagcatcacaatcccaaaactattcattatccccttttaaggtggctatcaatagactggctgtactctgctgggatataccacccattagtggtgacataggtattatagtgttagatcagtctagacaacccaaaa

SEQ ID NO: 836 - DNA, 200 bp, Ambrosia trifida
ttttgggttgtctagactgatctaacactataatacctatgtcaccactaatgggtggtatatcccagcagagtacagccagtctattgatagccaccttaaaaggggataatgaatagttttgggattgtgatgctagagctacctacaagatagagatatttaggctcaggtccaagcattcatgagaactggttgtg

SEQ ID NO: 837 - DNA, 200 bp, Ambrosia trifida
tgccaattgttgaccatattgaatcactaggtggcgaagtcagacttaattcacagatacaaaagattgagttaaacaaagatgggactgttaaaaactttttactcaatgatgggactatcatcaaaggtgatgcttatgtgtttgctactccaggtatgttaattaaaccaccatttggctttgaactttgaagtctc

SEQ ID NO: 838 - DNA, 200 bp, Ambrosia trifida
gagacttcaaagttcaaagccaaatggtggtttaattaacatacctggagtagcaaacacataagcatcacctttgatgatagtcccatcattgagtaaaaagtttttaacagtcccatctttgtttaactcaatcttttgtatctgtgaattaagtctgacttcgccacctagtgattcaatatggtcaacaattggca

SEQ ID NO: 839 - DNA, 200 bp, Ambrosia trifida
atttggctttgaactttgaagtctccacatatttctctctggggtccataagctttgctggctgtttgtatcaagcagttgacattctgaagcttcttttgcctgaaaattggaaaccggttccatacttcaaaaagttggaaaaattagttggtttttcagttataaatgttcatatatggttagatggaccctttcaa

SEQ ID NO: 840 - DNA, 200 bp, Ambrosia trifida
ttgaaagggtccatctaaccatatatgaacatttataactgaaaaaccaactaatttttccaactttttgaagtatggaaccggtttccaattttcaggcaaaagaagcttcagaatgtcaactgcttgatacaaacagccagcaaagcttatggaccccagagagaaatatgtggagacttcaaagttcaaagccaaat

SEQ ID NO: 841 - DNA, 200 bp, Ambrosia trifida
tatatggttagatggaccctttcaatataatgctaatccttataagataataataattcagccctttcacattttttattgtgaacccaattttaagataatgaattactactctttcgcttgtgtacaaccattccagatgatgtttttgaggattatgaatcacaagcaatgtatgcatctactgatataatgtggtt

SEQ ID NO: 842 - DNA, 200 bp, Ambrosia trifida
aaccacattatatcagtagatgcatacattgcttgtgattcataatcctcaaaaacatcatctggaatggttgtacacaagcgaaagagtagtaattcattatcttaaaattgggttcacaataaaaaatgtgaaagggctgaattattattatcttataaggattagcattatattgaaagggtccatctaaccatata

SEQ ID NO: 843 - DNA, 200 bp, Ambrosia trifida
tgtttgtatcaagcagttgacattctgaagcttcttttgcctgaagattggaaaccggttccatacttcaaaaagttggaaaaattagttggtgttccagttataaacgttcatatatggttggttagatggaccgaccctttcaatataatgctaatccttccttataaggtaataataattcagccaattttcaggtt

SEQ ID NO: 844 - DNA, 200 bp, Ambrosia trifida
aacctgaaaattggctgaattattattaccttataaggaaggattagcattatattgaaagggtcggtccatctaaccaaccatatatgaacgtttataactggaacaccaactaatttttccaactttttgaagtatggaaccggtttccaatcttcaggcaaaagaagcttcagaatgtcaactgcttgatacaaaca

SEQ ID NO: 845 - DNA, 200 bp, Ambrosia trifida
taataattcagccaattttcaggtttgacaggaagctcaaaaacacttatgatcacctacttttcagcaggtcgtcatctcttacttcttgcaaaacagttaattattttctcataaaaaatgttggcttttttacttttcaacatgtcacctcttatcattgcattgctgctactgtcgatttatatttttcttccatc

SEQ ID NO: 846 - DNA, 200 bp, Ambrosia trifida
gatggaagaaaaatataaatcgacagtagcagcaatgcaatgataagaggtgacatgttgaaaagtaaaaaagccaacattttttatgagaaaataattaactgttttgcaagaagtaagagatgacgacctgctgaaaagtaggtgatcataagtgtttttgagcttcctgtcaaacctgaaaattggctgaattatta

SEQ ID NO: 847 - DNA, 200 bp, Ambrosia trifida
tgtcgatttatatttttcttccatcttttccagaagccctcttcttagtgtatatgctgacatgtctgttacatgtaaggtaatacttgtatggcaattgacatgttaactacattaccttttttaccccacagacgaaagactgttaaacaagttgctcatattattcaggaatattatgatccaaatcggtcaatgtt

SEQ ID NO: 848 - DNA, 200 bp, Ambrosia trifida
aacattgaccgatttggatcataatattcctgaataatatgagcaacttgtttaacagtctttcgtctgtggggtaaaaaaggtaatgtagttaacatgtcaattgccatacaagtattaccttacatgtaacagacatgtcagcatatacactaagaagagggcttctggaaaagatggaagaaaaatataaatcgaca

SEQ ID NO: 849 - DNA, 200 bp, Ambrosia trifida
attatgatccaaatcggtcaatgttggaattggtttttgcacccgcagaagaatggattgcacgcagcgactctgacattattgatgccaccatgagtgaactttcaagactctttcctgatgaaattgcagcagatgggagcaaagcaaaaatattgaaatatcatgtagtaaaaacaccaaggctagtattcacatgt

SEQ ID NO: 850 - DNA, 200 bp, Ambrosia trifida
acatgtgaatactagccttggtgtttttactacatgatatttcaatatttttgctttgctcccatctgctgcaatttcatcaggaaagagtcttgaaagttcactcatggtggcatcaataatgtcagagtcgctgcgtgcaatccattcttctgcgggtgcaaaaaccaattccaacattgaccgatttggatcataat

SEQ ID NO: 851 - DNA, 200 bp, Ambrosia trifida
aacaccaaggctagtattcacatgtgcaaaccgaagacaaatttgtttattctgatgaagtattaattaattattgggttgtggtgcttcaggtcggtttataaaactgtgccagactgtgaaccttgccgtcccttgcaaagatctccaatagaaggattttatttagctggtgattacacgaaacaaaagtatttggc

SEQ ID NO: 852 - DNA, 200 bp, Ambrosia trifida
gccaaatacttttgtttcgtgtaatcaccagctaaataaaatccttctattggagatctttgcaagggacggcaaggttcacagtctggcacagttttataaaccgacctgaagcaccacaacccaataattaattaatacttcatcagaataaacaaatttgtcttcggtttgcacatgtgaatactagccttggtgtt

SEQ ID NO: 853 - DNA, 200 bp, Ambrosia trifida
attacacgaaacaaaagtatttggcttcaatggagggtgctgttttgtcaggaaaattttgtgcccaggctattgtacaggtaataaataattgagtaagcataaaacacaaacaaggcgagattttgtgtgatctcatgcatcatcttgttatgttacacaggattacgagttgcttgctgcgaggggggaggtgatgg

SEQ ID NO: 854 - DNA, 200 bp, Ambrosia trifida
ccatcacctcccccctcgcagcaagcaactcgtaatcctgtgtaacataacaagatgatgcatgagatcacacaaaatctcgccttgtttgtgttttatgcttactcaattatttattacctgtacaatagcctgggcacaaaattttcctgacaaaacagcaccctccattgaagccaaatacttttgtttcgtgtaat

SEQ ID NO: 855 - DNA, 200 bp, Ambrosia trifida
cttgctgcgaggggggaggtgatggctgaagcaagcctggtctaagatgacgtggcaagttgaaaattgataaaaacacccatccatccatagaacttatcttgtatctgttactttatacatgcattgattaatcagtatttgaaatagcaattgcttgtgaaaaagtttgggtgatgaacacagttttgacttgttta

SEQ ID NO: 856 - DNA, 200 bp, Ambrosia trifida
taaacaagtcaaaactgtgttcatcacccaaactttttcacaagcaattgctatttcaaatactgattaatcaatgcatgtataaagtaacagatacaagataagttctatggatggatgggtgtttttatcaattttcaacttgccacgtcatcttagaccaggcttgcttcagccatcacctcccccctcgcagcaag

SEQ ID NO: 857 - DNA, 200 bp, Ambrosia trifida
tttcttttctgtctttctcctcactttcttttgcttattattattattattatgcaggtttggctggtctatccactgctaagtatttggctgatgccggtcataagccccttttgcttgaagcaagagacgttcttggtggaaaggttgcggcttggaaagatgatgacggagattggtacgagacaggcttacacatt

SEQ ID NO: 858 - DNA, 200 bp, Ambrosia trifida
aatgtgtaagcctgtctcgtaccaatctccgtcatcatctttccaagccgcaacctttccaccaagaacgtctcttgcttcaagcaaaaggggcttatgaccggcatcagccaaatacttagcagtggatagaccagccaaacctgcataataataataataataagcaaaagaaagtgaggagaaagacagaaaagaaa

SEQ ID NO: 859 - DNA, 200 bp, Ambrosia trifida
ttggtacgagacaggcttacacattttctgtaagtttttactttactcaactaactaactaataatggatggaaaatcagctgctttaactaactcttccctttgcttcacagttggagcttacccaaatgtacagaacctctttggagagttagggattaatgatagactacaatggaaggagcattctatgatttttg

SEQ ID NO: 860 - DNA, 200 bp, Ambrosia trifida
caaaaatcatagaatgctccttccattgtagtctatcattaatccctaactctccaaagaggttctgtacatttgggtaagctccaactgtgaagcaaagggaagagttagttaaagcagctgattttccatccattattagttagttagttgagtaaagtaaaaacttacagaaaatgtgtaagcctgtctcgtaccaa

SEQ ID NO: 861 - DNA, 200 bp, Ambrosia trifida
tggaaggagcattctatgatttttgcaatgccaaacaagcctggtgaatttagtcgcttcgacttcccagatgttttgcctgcaccactaaatggcaagtatgctattatttactaactacctcatgctattacttactatgaatcttatcttcattctaatttgcatgttattataggaatttgggctatcttgaggaa

SEQ ID NO: 862 - DNA, 200 bp, Ambrosia trifida
ttcctcaagatagcccaaattcctataataacatgcaaattagaatgaagataagattcatagtaagtaatagcatgaggtagttagtaaataatagcatacttgccatttagtggtgcaggcaaaacatctgggaagtcgaagcgactaaattcaccaggcttgtttggcattgcaaaaatcatagaatgctccttcca

SEQ ID NO: 863 - DNA, 200 bp, Commelina diffusa
cctattgggccgttcactggtctattgttgaaacagttgatatattgaagcttcttttgcctcaagaatggagggaaattccctactttaagaagctggaaaagctagtgggagttccagtgattaatgtccatatatggtgagtcattttttctctagcaatttctgctacttcttagtgacagtccctcatataaatg

SEQ ID NO: 864 - DNA, 200 bp, Commelina diffusa
catttatatgagggactgtcactaagaagtagcagaaattgctagagaaaaaatgactcaccatatatggacattaatcactggaactcccactagcttttccagcttcttaaagtagggaatttccctccattcttgaggcaaaagaagcttcaatatatcaactgtttcaacaatagaccagtgaacggcccaatagg

SEQ ID NO: 865 - DNA, 200 bp, Commelina diffusa
cgcctgtcatcttagcatcctcataaagtcaagaaattgtgaggacaaatatatttactaactgatggaaacttgatgtttttatcgtggtatccagtatccacttgtgagctgttctgtagattgatatataggaagatatatgacaaacaagatttctatgattttgctaccacttataagcaaagaacaaaagaagt

SEQ ID NO: 866 - DNA, 200 bp, Commelina diffusa
acttcttttgttctttgcttataagtggtagcaaaatcatagaaatcttgtttgtcatatatcttcctatatatcaatctacagaacagctcacaagtggatactggataccacgataaaaacatcaagtttccatcagttagtaaatatatttgtcctcacaatttcttgactttatgaggatgctaagatgacaggcg

SEQ ID NO: 867 - DNA, 200 bp, Commelina diffusa
cttataagcaaagaacaaaagaagtacaatagatatgtatatatatatctctcgcatgcttttctttaaaactataatgggtgtacaatgattatgattttttttgtgtgtgtatgcctacagggtgtaccagacagggtcaatgacgaagtctttattgccatgtctaaggcactcaatttcataaacccagacgagct

SEQ ID NO: 868 - DNA, 200 bp, Commelina diffusa
agctcgtctgggtttatgaaattgagtgccttagacatggcaataaagacttcgtcattgaccctgtctggtacaccctgtaggcatacacacacaaaaaaaatcataatcattgtacacccattatagttttaaagaaaagcatgcgagagatatatatatacatatctattgtacttcttttgttctttgcttataag

SEQ ID NO: 869 - DNA, 200 bp, Commelina diffusa
gggtgtaccagacagggtcaatgacgaagtctttattgccatgtctaaggcactcaatttcataaacccagacgagctttccatgcagtgcattttaattgctttaaaccgttttcttcaggaaaagaatggctccaagatggccttcttagatggtaaccctcctgaaagattatgcatgccaattgttgatcatgtcc

SEQ ID NO: 870 - DNA, 200 bp, Commelina diffusa
ggacatgatcaacaattggcatgcataatctttcaggagggttaccatctaagaaggccatcttggagccattcttttcctgaagaaaacggtttaaagcaattaaaatgcactgcatggaaagctcgtctgggtttatgaaattgagtgccttagacatggcaataaagacttcgtcattgaccctgtctggtacaccc

SEQ ID NO: 871 - DNA, 200 bp, Commelina diffusa
tgcatgccaattgttgatcatgtccgctccttaggtggtgaggtgcagcttaattcacgtattcagaaaattgaactaaaccctgatggtactgtgaagcacttcctgctgagcaatggaaatatcattacaggagacgtttatgtatttgcagctcctgttgatatattgaagcttcttttgcctcaagaatggaggga

SEQ ID NO: 872 - DNA, 200 bp, Commelina diffusa
tccctccattcttgaggcaaaagaagcttcaatatatcaacaggagctgcaaatacataaacgtctcctgtaatgatatttccattgctcagcaggaagtgcttcacagtaccatcagggtttagttcaattttctgaatacgtgaattaagctgcacctcaccacctaaggagcggacatgatcaacaattggcatgca

SEQ ID NO: 873 - DNA, 200 bp, Conyza canadensis
acaacatcccttgtttcctcttcttcttgttttctttttctttctttttgctaaaaaactcacacacgcagaagaagaagacgaagacaaagtcagagagttgagtttggactgattgattgatttgttattaagggctggtgtttgtctgatcatctgcagcgagctgatagtattattattatgtctctttttggaaa

SEQ ID NO: 874 - DNA, 200 bp, Conyza canadensis
tttccaaaaagagacataataataatactatcagctcgctgcagatgatcagacaaacaccagcccttaataacaaatcaatcaatcagtccaaactcaactctctgactttgtcttcgtcttcttcttctgcgtgtgtgagttttttagcaaaaagaaagaaaaagaaaacaagaagaagaggaaacaagggatgttgt

SEQ ID NO: 875 - DNA, 200 bp, Conyza canadensis
ttattattatgtctctttttggaaatgtctctgccattaacctaactggaaactgtctgctatcaatcactagttccagagatgttttgtcatttcggcacggtgatactatgggttatcgcttgcaatcccccccttcttttattaccaaaactaacaaaaatgtctcccctttgaaggtagtttgtgtcgactatcca

SEQ ID NO: 876 - DNA, 200 bp, Conyza canadensis
tggatagtcgacacaaactaccttcaaaggggagacatttttgttagttttggtaataaaagaagggggggattgcaagcgataacccatagtatcaccgtgccgaaatgacaaaacatctctggaactagtgattgatagcagacagtttccagttaggttaatggcagagacatttccaaaaagagacataataataa

SEQ ID NO: 877 - DNA, 200 bp, Conyza canadensis
gaaggtagtttgtgtcgactatccaagaccagacctcgataacacctctaatttcttggaagctgcttatttgtcttctaccttccgagcttctccacgcccacctaagccattgaaggttgtaattgctggtgcaggtctcgctggtttatcaactgcaaagtacttggctgatgccggtcacaagccaattttgctag

SEQ ID NO: 878 - DNA, 200 bp, Conyza canadensis
ctagcaaaattggcttgtgaccggcatcagccaagtactttgcagttgataaaccagcgagacctgcaccagcaattacaaccttcaatggcttaggtgggcgtggagaagctcggaaggtagaagacaaataagcagcttccaagaaattagaggtgttatcgaggtctggtcttggatagtcgacacaaactaccttc

SEQ ID NO: 879 - DNA, 200 bp, Conyza canadensis
gccggtcacaagccaattttgctagaagcaagagatgttcttggtggaaaggtagctgcctggaaagatgatgatggagattggtacgagactggtttacacatattttttggagcttacccgaatatacagaatctgtttggagagttaggcattaatgatagattgcagtggaaggagcattcaatgatatttgcgat

SEQ ID NO: 880 - DNA, 200 bp, Conyza canadensis
atcgcaaatatcattgaatgctccttccactgcaatctatcattaatgcctaactctccaaacagattctgtatattcgggtaagctccaaaaaatatgtgtaaaccagtctcgtaccaatctccatcatcatctttccaggcagctacctttccaccaagaacatctcttgcttctagcaaaattggcttgtgaccggc

SEQ ID NO: 881 - DNA, 200 bp, Conyza canadensis
aggagcattcaatgatatttgcgatgccaaacaaacctggagaatttagtcggtttgatttcccagatgttctgccggcaccattgaatggaatttgggctatcttgaggaacaatgaaatgctgacatggcctgagaaagtaaaatttgctatcgggctcttgcctgcaatgttaggtggacaggcttatgttgaggca

SEQ ID NO: 882 - DNA, 200 bp, Conyza canadensis
tgcctcaacataagcctgtccacctaacattgcaggcaagagcccgatagcaaattttactttctcaggccatgtcagcatttcattgttcctcaagatagcccaaattccattcaatggtgccggcagaacatctgggaaatcaaaccgactaaattctccaggtttgtttggcatcgcaaatatcattgaatgctcct

SEQ ID NO: 883 - DNA, 200 bp, Conyza canadensis
aggtggacaggcttatgttgaggcacaagatggtctgagtgttcaagactggatgagacaacggggcataccagatcgagttactacagaggtgtttattgccatgtcaaaggcattaaacttcatcaatccagatgaactttcaatgcaatgtattctgattgctctgaaccgatttcttcaggagaagcatggttcta

SEQ ID NO: 884 - DNA, 200 bp, Conyza canadensis
tagaaccatgcttctcctgaagaaatcggttcagagcaatcagaatacattgcattgaaagttcatctggattgatgaagtttaatgcctttgacatggcaataaacacctctgtagtaactcgatctggtatgccccgttgtctcatccagtcttgaacactcagaccatcttgtgcctcaacataagcctgtccacct

SEQ ID NO: 885 - DNA, 200 bp, Conyza canadensis
tttcttcaggagaagcatggttctaagatggcatttttagatggcagcccacctgaaagactttgcatgccaattgttgagcatattgagtcactaggtggccaagtcaggcttaattcacgaatacaaaagatcgagttgaacaaagatggaacagttaggaactttttactttatgatggaaatattattgaaggtga

SEQ ID NO: 886 - DNA, 200 bp, Conyza canadensis
tcaccttcaataatatttccatcataaagtaaaaagttcctaactgttccatctttgttcaactcgatcttttgtattcgtgaattaagcctgacttggccacctagtgactcaatatgctcaacaattggcatgcaaagtctttcaggtgggctgccatctaaaaatgccatcttagaaccatgcttctcctgaagaaa

SEQ ID NO: 887 - DNA, 200 bp, Conyza canadensis
atgatggaaatattattgaaggtgatgcttatgtatttgctactccagttgatattctgaagcttctgttgcctgaagattggaaagcaattccttacttcaagaagttggataaattagttggtgtcccagttataaacgttcatatatggtttgacaggaaactcaaaaacacctatgatcacctactcttcagcagg

SEQ ID NO: 888 - DNA, 200 bp, Conyza canadensis
cctgctgaagagtaggtgatcataggtgtttttgagtttcctgtcaaaccatatatgaacgtttataactgggacaccaactaatttatccaacttcttgaagtaaggaattgctttccaatcttcaggcaacagaagcttcagaatatcaactggagtagcaaatacataagcatcaccttcaataatatttccatcat

SEQ ID NO: 889 - DNA, 200 bp, Conyza canadensis
ctatgatcacctactcttcagcaggagccctcttctcagtgtatatgccgacatgtctgtaacatgcaaggaatactatgatcctaaccggtccatgttagagttggtttttgcacctgcagaagaatggatttcacgcagtgactctgatattattgacgctacgatgagtgaactttcaagactatttccggatgaaa

SEQ ID NO: 890 - DNA, 200 bp, Conyza canadensis
tttcatccggaaatagtcttgaaagttcactcatcgtagcgtcaataatatcagagtcactgcgtgaaatccattcttctgcaggtgcaaaaaccaactctaacatggaccggttaggatcatagtattccttgcatgttacagacatgtcggcatatacactgagaagagggctcctgctgaagagtaggtgatcatag

SEQ ID NO: 891 - DNA, 200 bp, Conyza canadensis
ctttcaagactatttccggatgaaattgcagcagatcagagcaaagcaaaaatattgaaataccatgtagttaaaaccccaaggtcagtttacaaaactgtacctgactgtgaaccttgccgtccattacaaagatctccattagagggattctatttagctggcgactacacgaaacaaaagtatctggcttcaatgga

SEQ ID NO: 892 - DNA, 200 bp, Conyza canadensis
tccattgaagccagatacttttgtttcgtgtagtcgccagctaaatagaatccctctaatggagatctttgtaatggacggcaaggttcacagtcaggtacagttttgtaaactgaccttggggttttaactacatggtatttcaatatttttgctttgctctgatctgctgcaatttcatccggaaatagtcttgaaag

SEQ ID NO: 893 - DNA, 200 bp, Conyza canadensis
aacaaaagtatctggcttcaatggagggtgctgttctatcaggaaaattttgcgcccaagcgattgtaaaggattatgagttgcttgctgccaggagggaagtggttgctgaggcaagccttgtctaactgtatagatgcaagataacttggtaagttaaaaatcagttgaagacaagagcacgtggttctttgcatatt

SEQ ID NO: 894 - DNA, 200 bp, Conyza canadensis
aatatgcaaagaaccacgtgctcttgtcttcaactgatttttaacttaccaagttatcttgcatctatacagttagacaaggcttgcctcagcaaccacttccctcctggcagcaagcaactcataatcctttacaatcgcttgggcgcaaaattttcctgatagaacagcaccctccattgaagccagatacttttgtt

SEQ ID NO: 895 - DNA, 200 bp, Conyza canadensis
aagagcacgtggttctttgcatatttgactttttatggtccttggctgaagtggtaggcttaaggaggtggcagaatttctgggaggagcttttacaagttcagaagaagctaaacataaatacacccatagcaattcattgttctaactgaaacttatttcatatttgtcaaagaaaaaatacatattcctgttatgta

SEQ ID NO: 896 - DNA, 200 bp, Conyza canadensis
tacataacaggaatatgtattttttctttgacaaatatgaaataagtttcagttagaacaatgaattgctatgggtgtatttatgtttagcttcttctgaacttgtaaaagctcctcccagaaattctgccacctccttaagcctaccacttcagccaaggaccataaaaagtcaaatatgcaaagaaccacgtgctctt

SEQ ID NO: 897 - DNA, 200 bp, Conyza canadensis
acacacacatgtatatatatatagaccaattcggttttcgaattggttttgtttaaaaagcaacaactcgtaaatcaaattatcaaaccataaaccgaatttcaaaatcaatttgttgtcaaaccaaactaaaaactcaaaaaaaccaaatgaatttcaataaatttttatttcaatttggtttgataattggtttcatc

SEQ ID NO: 898 - DNA, 200 bp, Conyza canadensis
gatgaaaccaattatcaaaccaaattgaaataaaaatttattgaaattcatttggtttttttgagtttttagtttggtttgacaacaaattgattttgaaattcggtttatggtttgataatttgatttacgagttgttgctttttaaacaaaaccaattcgaaaaccgaattggtctatatatatatacatgtgtgtgt

SEQ ID NO: 899 - DNA, 200 bp, Conyza canadensis
atttggtttgataattggtttcatcgacttggatccgtacactgaacacccctacttacatgtactagtactttctgtagattacttagcatgtgaacaccttcatgtttcacccatctgtgaacgttgtaaacttaatttttgtacagttgtatctgcgatatatactagtttgtgacccaatagatagatttattaat

SEQ ID NO: 900 - DNA, 200 bp, Conyza canadensis
attaataaatctatctattgggtcacaaactagtatatatcgcagatacaactgtacaaaaattaagtttacaacgttcacagatgggtgaaacatgaaggtgttcacatgctaagtaatctacagaaagtactagtacatgtaagtaggggtgttcagtgtacggatccaagtcgatgaaaccaattatcaaaccaaat

SEQ ID NO: 901 - DNA, 200 bp, Conyza canadensis
tgacccaatagatagatttattaattatcatatagttatgtaattatatttccatgtattgtttattctatttcataattgtgtaacaggtcagtttacaaaactgtacctgactgtgaaccttgccgtccattacaaagatctccattagagggattctatttagctggcgactacacgaaacaaaagtatctggcttc

SEQ ID NO: 902 - DNA, 200 bp, Conyza canadensis
gaagccagatacttttgtttcgtgtagtcgccagctaaatagaatccctctaatggagatctttgtaatggacggcaaggttcacagtcaggtacagttttgtaaactgacctgttacacaattatgaaatagaataaacaatacatggaaatataattacataactatatgataattaataaatctatctattgggtca

SEQ ID NO: 903 - DNA, 200 bp, Conyza canadensis
acacgaaacaaaagtatctggcttcaatggagggtgctgttctatcaggaaaattttgcgcccaagcgattgtaaaggtaatgttaaagcaactcgtagctggtagttttagaattatttagcaagtgaaagtatttttctctgctgctttttagagtagtgcaatttgcagcagacgaattttgggtatgtgtttataa

SEQ ID NO: 904 - DNA, 200 bp, Conyza canadensis
ttataaacacatacccaaaattcgtctgctgcaaattgcactactctaaaaagcagcagagaaaaatactttcacttgctaaataattctaaaactaccagctacgagttgctttaacattacctttacaatcgcttgggcgcaaaattttcctgatagaacagcaccctccattgaagccagatacttttgtttcgtgt

SEQ ID NO: 905 - DNA, 200 bp, Conyza canadensis
acgaattttgggtatgtgtttataagtgaccataaaaagacaaagtagcctacatattctgttgctcatcttctgatgcatcatgtaacacaggattatgagttgcttgctgccaggagggaagtggttgctgaggcaagccttgtctaactgtatagatgcaagataacttggtaagttaaaaatcagttgaagacaag

SEQ ID NO: 906 - DNA, 200 bp, Conyza canadensis
cttgtcttcaactgatttttaacttaccaagttatcttgcatctatacagttagacaaggcttgcctcagcaaccacttccctcctggcagcaagcaactcataatcctgtgttacatgatgcatcagaagatgagcaacagaatatgtaggctactttgtctttttatggtcacttataaacacatacccaaaattcgt

SEQ ID NO: 907 - DNA, 200 bp, Conyza canadensis
aagttaaaaatcagttgaagacaagagcacgtggttctttgcatatttgactttttatggtccttggctgaagtggtaggcttaaggaggtggcagaatttctgggaggagcttttacaagttcagaagaagctaaacataaatacacccatagcaattcattgttctaactgaaacttatttcatatttgtcaaagaaa

SEQ ID NO: 908 - DNA, 200 bp, Conyza canadensis
tttctttgacaaatatgaaataagtttcagttagaacaatgaattgctatgggtgtatttatgtttagcttcttctgaacttgtaaaagctcctcccagaaattctgccacctccttaagcctaccacttcagccaaggaccataaaaagtcaaatatgcaaagaaccacgtgctcttgtcttcaactgatttttaactt

SEQ ID NO: 909 - DNA, 200 bp, Conyza canadensis
acttatttcatatttgtcaaagaaaaaaatacatattcctgttatgtacatagttggttattttcccttgttttatacgtcatgtgtggcatcgaatctattgattatctatacgtattatatgtggcatgtttttttttaattttgcatcctgatctttgattacacttttcaagatttattcactttgcttccatggc

SEQ ID NO: 910 - DNA, 200 bp, Conyza canadensis
gccatggaagcaaagtgaataaatcttgaaaagtgtaatcaaagatcaggatgcaaaattaaaaaaaaacatgccacatataatacgtatagataatcaatagattcgatgccacacatgacgtataaaacaagggaaaataaccaactatgtacataacaggaatatgtatttttttctttgacaaatatgaaataagt

SEQ ID NO: 911 - DNA, 200 bp, Conyza canadensis
gatttattcactttgcttccatggcatacaagaaaacaatatcaatacagcgagctatctattatgtaacttgggagatgcaggtgcatgagaagtgctcaaaacttcaactacttggtgggattaagttgaagtgacactaacccaggtaccaacctcatcccgaaaatctgtgaatattttctttttattcgtcttag

SEQ ID NO: 912 - DNA, 200 bp, Conyza canadensis
ctaagacgaataaaaagaaaatattcacagattttcgggatgaggttggtacctgggttagtgtcacttcaacttaatcccaccaagtagttgaagttttgagcacttctcatgcacctgcatctcccaagttacataatagatagctcgctgtattgatattgttttcttgtatgccatggaagcaaagtgaataaatc

SEQ ID NO: 913 - DNA, 200 bp, Conyza canadensis
aatattttctttttattcgtcttagttaaaaaaagaaaaaaaagaaacagatgatgcaccagttcaatactttttgttcgataccttgattatttaccaaatgagacacactgtatgtctgtatgtgctttcatcttgtttcattttgtgggaatgtggagtaacaggtataagaatagcaataacacaagtctagttgc

SEQ ID NO: 914 - DNA, 200 bp, Conyza canadensis
gcaactagacttgtgttattgctattcttatacctgttactccacattcccacaaaatgaaacaagatgaaagcacatacagacatacagtgtgtctcatttggtaaataatcaaggtatcgaacaaaaagtattgaactggtgcatcatctgtttcttttttttctttttttaactaagacgaataaaaagaaaatatt

SEQ ID NO: 915 - DNA, 200 bp, Conyza canadensis
atagcaataacacaagtctagttgctgaagagtgtgagcagagtaagattttggtatgataccaagtaaagtaaatgcgtagagagtaaggtttaggtgattccttaatgaaatgggaaccttgtgattgtcaatgagttattaatccattgaatttgaaatttcacaacgtgaaataacttgtgctcttacaaaatgtt

SEQ ID NO: 916 - DNA, 200 bp, Conyza canadensis
aacattttgtaagagcacaagttatttcacgttgtgaaatttcaaattcaatggattaataactcattgacaatcacaaggttcccatttcattaaggaatcacctaaaccttactctctacgcatttactttacttggtatcataccaaaatcttactctgctcacactcttcagcaactagacttgtgttattgctat

SEQ ID NO: 917 - DNA, 200 bp, Conyza canadensis
ataacttgtgctcttacaaaatgttttgtggtcatatatttaccaatacatgtgtcttcttggacactaaaaaaaatagatagctggtgaagatactatataatttaataataagataagatagcgtctactttgctgaaaagtcaaaactggattaccaaatctcattctcacgtgtcaaaatttgacaggatcttttg

SEQ ID NO: 918 - DNA, 200 bp, Conyza canadensis
caaaagatcctgtcaaattttgacacgtgagaatgagatttggtaatccagttttgacttttcagcaaagtagacgctatcttatcttattattaaattatatagtatcttcaccagctatctattttttttagtgtccaagaagacacatgtattggtaaatatatgaccacaaaacattttgtaagagcacaagttat

SEQ ID NO: 919 - DNA, 200 bp, Conyza canadensis
tgtcaaaatttgacaggatcttttgaaattcacttgttggacattggcactggatcatgcaaagggatcacatttctcttcaagccttatcccattcccagctatagataccataaatataaacgctggaagtgcagtattgaattacctgatttatgtttttggatgtggggggttttaggaggtgatatgtaatcaaa

SEQ ID NO: 920 - DNA, 200 bp, Conyza canadensis
tttgattacatatcacctcctaaaaccccccacatccaaaaacataaatcaggtaattcaatactgcacttccagcgtttatatttatggtatctatagctgggaatgggataaggcttgaagagaaatgtgatccctttgcatgatccagtgccaatgtccaacaagtgaatttcaaaagatcctgtcaaattttgaca

SEQ ID NO: 921 - DNA, 200 bp, Conyza canadensis
ttttaggaggtgatatgtaatcaaaaacttaacccaatccattcaaagattgtgtgttgtgatatgacctaaagaaagtgagagagagagagattattcttaattctaaagtaataaattgtgaaggcaaataagccgacagcatgttcctgatacacatatccatcacaacatcccctcccaactttgtcacttccatt

SEQ ID NO: 922 - DNA, 200 bp, Conyza canadensis
aatggaagtgacaaagttgggaggggatgttgtgatggatatgtgtatcaggaacatgctgtcggcttatttgccttcacaatttattactttagaattaagaataatctctctctctctcactttctttaggtcatatcacaacacacaatctttgaatggattgggttaagtttttgattacatatcacctcctaaaa

SEQ ID NO: 923 - DNA, 200 bp, Conyza canadensis
ccctcccaactttgtcacttccattttactccacactatatatacgcacacctctttcaacaatggcttctactgtacagaacatccccacttttttgagctttttcacggtgtctgcatgaagttaagagtttgacatctgctcgcattcaccccccctttggccttgatttcttcccacatataacttcaaacttaat

SEQ ID NO: 924 - DNA, 200 bp, Conyza canadensis
attaagtttgaagttatatgtgggaagaaatcaaggccaaagggggggtgaatgcgagcagatgtcaaactcttaacttcatgcagacaccgtgaaaaagctcaaaaaagtggggatgttctgtacagtagaagccattgttgaaagaggtgtgcgtatatatagtgtggagtaaaatggaagtgacaaagttgggaggg

SEQ ID NO: 925 - DNA, 200 bp, Conyza canadensis
tcccacatataacttcaaacttaattaatgaattgaatgcgacccgactcttttccatgcaaatcagtggtcacttatcaatgttgattgttgactcgatcccatctataaataccccttcttgccattttctctctcagggtcccagctccacatctgtgaggctttttttcttttggtcccaaatctttcaaaaaaac

SEQ ID NO: 926 - DNA, 200 bp, Conyza canadensis
gtttttttgaaagatttgggaccaaaagaaaaaaagcctcacagatgtggagctgggaccctgagagagaaaatggcaagaaggggtatttatagatgggatcgagtcaacaatcaacattgataagtgaccactgatttgcatggaaaagagtcgggtcgcattcaattcattaattaagtttgaagttatatgtggga

SEQ ID NO: 927 - DNA, 200 bp, Conyza canadensis
ttggtcccaaatctttcaaaaaaacacaaacagaaaatggcaacagctttacaaacaaagatagaagggaatcgtattacaacaaagtgtgcttccttagtaaagaaacagcgagctcgtatatatatcctacgtcgttgtgccaccatgcttctctgctggtacattcaaggagatgaataaatagttgatgctatgac

SEQ ID NO: 928 - DNA, 200 bp, Conyza canadensis
gtcatagcatcaactatttattcatctccttgaatgtaccagcagagaagcatggtggcacaacgacgtaggatatatatacgagctcgctgtttctttactaaggaagcacactttgttgtaatacgattcccttctatctttgtttgtaaagctgttgccattttctgtttgtgtttttttgaaagatttgggaccaa

SEQ ID NO: 929 - DNA, 200 bp, Conyza canadensis
atgaataaatagttgatgctatgacacaaacaacagacatgtttttatcctcgattcttatagtctctatatcccttttttcacatcaactcatgtggctcccgttttcggttcttttctttggcttatacatattcttaaatatgcatgccctaaacttccatctttttaacaccaacggtccgttgcatttaaaggct

SEQ ID NO: 930 - DNA, 200 bp, Conyza canadensis
agcctttaaatgcaacggaccgttggtgttaaaaagatggaagtttagggcatgcatatttaagaatatgtataagccaaagaaaagaaccgaaaacgggagccacatgagttgatgtgaaaaaagggatatagagactataagaatcgaggataaaaacatgtctgttgtttgtgtcatagcatcaactatttattcat

SEQ ID NO: 931 - DNA, 200 bp, Conyza canadensis
caacggtccgttgcatttaaaggctgttaggtcttgtctcattttctactccctagtttttgtcatgtcttgtttatcttgacctctcttcatttgtcctgtttaaaacactttttttatccaaatggttttcatttgggttttttgggcatctgcatcagaggacaatttcaactttagacatggaccagaaacgggga

SEQ ID NO: 932 - DNA, 200 bp, Conyza canadensis
tccccgtttctggtccatgtctaaagttgaaattgtcctctgatgcagatgcccaaaaaacccaaatgaaaaccatttggataaaaaaagtgttttaaacaggacaaatgaagagaggtcaagataaacaagacatgacaaaaactagggagtagaaaatgagacaagacctaacagcctttaaatgcaacggaccgttg

SEQ ID NO: 933 - DNA, 200 bp, Conyza canadensis
tttagacatggaccagaaacggggatatgaccagcatgaaggaagcaatcttgcatcaagttggcagcttgaaatgaaggttctacaataacatcttgcgttgtgtcatggtttgtagataattgtctccgctgaaaataaatgacggttcctcacttccttgatatgtaaagcactcataaaatgattaataattcggt

SEQ ID NO: 934 - DNA, 200 bp, Conyza canadensis
accgaattattaatcattttatgagtgctttacatatcaaggaagtgaggaaccgtcatttattttcagcggagacaattatctacaaaccatgacacaacgcaagatgttattgtagaaccttcatttcaagctgccaacttgatgcaagattgcttccttcatgctggtcatatccccgtttctggtccatgtctaaa

SEQ ID NO: 935 - DNA, 200 bp, Conyza canadensis
ctcataaaatgattaataattcggtgctgctacaaatatatatgttgaagcgcactaaatctgaagttgtgatttattcatcgggatgtttttttctttttaataatgactttttcatcatttaagttgacatatacagcacccactaatgctaatatcttaaatctccacatttcccttgcaatcaccaagacaacttg

SEQ ID NO: 936 - DNA, 200 bp, Conyza canadensis
caagttgtcttggtgattgcaagggaaatgtggagatttaagatattagcattagtgggtgctgtatatgtcaacttaaatgatgaaaaagtcattattaaaaagaaaaaaacatcccgatgaataaatcacaacttcagatttagtgcgcttcaacatatatatttgtagcagcaccgaattattaatcattttatgag

SEQ ID NO: 937 - DNA, 200 bp, Conyza canadensis
cccttgcaatcaccaagacaacttgctgttagcataaccagacactgctactaactttaaccatcaaaagcacataatcccgcaggtcttcaaatccaaatgaggccggacatcatagaacttgtaattttaactcacatagaagtttgatagtgtgatatatgacaagggcagatggtaataagtagagctagcaaatc

SEQ ID NO: 938 - DNA, 200 bp, Conyza canadensis
gatttgctagctctacttattaccatctgcccttgtcatatatcacactatcaaacttctatgtgagttaaaattacaagttctatgatgtccggcctcatttggatttgaagacctgcgggattatgtgcttttgatggttaaagttagtagcagtgtctggttatgctaacagcaagttgtcttggtgattgcaaggg

SEQ ID NO: 939 - DNA, 200 bp, Conyza canadensis
tggtaataagtagagctagcaaatccttttcatattgttaatcctctctcaaaatggacgaggaagctctaaaactgcagaaaacaaacttttacaaacgaatttaaagctttaagagggaataaggaacaggcatgtcattgaagaatgctatctatttattatggaagatctgtgaccttaaaatcccataaatatga

SEQ ID NO: 940 - DNA, 200 bp, Conyza canadensis
tcatatttatgggattttaaggtcacagatcttccataataaatagatagcattcttcaatgacatgcctgttccttattccctcttaaagctttaaattcgtttgtaaaagtttgttttctgcagttttagagcttcctcgtccattttgagagaggattaacaatatgaaaaggatttgctagctctacttattacca

SEQ ID NO: 941 - DNA, 200 bp, Conyza canadensis
tgaccttaaaatcccataaatatgatatgtgtcggatcgtccagaatgaaaagtagctcaagttgttagaaatgttaagtagacacagatgttgtatggaactatggaagttcacttatctactgtaatgagcttccatctctcccaatgaattccaaaaccctgactcaccttcaaattaattccagctcgtgaaccaa

SEQ ID NO: 942 - DNA, 200 bp, Conyza canadensis
ttggttcacgagctggaattaatttgaaggtgagtcagggttttggaattcattgggagagatggaagctcattacagtagataagtgaacttccatagttccatacaacatctgtgtctacttaacatttctaacaacttgagctacttttcattctggacgatccgacacatatcatatttatgggattttaaggtca

SEQ ID NO: 943 - DNA, 200 bp, Conyza canadensis
aaattaattccagctcgtgaaccaaatttgtgattctggacaccaacccttatcaaagaatttaattaaattggcaattgacttgagatgtttgaaattcaattttagagaatagaagtttcatacaatcaacgaatgaactttattacatctgtgtattttaacagcgtacgtttcctgcttaactcgagtgctggatc

SEQ ID NO: 944 - DNA, 200 bp, Conyza canadensis
gatccagcactcgagttaagcaggaaacgtacgctgttaaaatacacagatgtaataaagttcattcgttgattgtatgaaacttctattctctaaaattgaatttcaaacatctcaagtcaattgccaatttaattaaattctttgataagggttggtgtccagaatcacaaatttggttcacgagctggaattaattt

SEQ ID NO: 945 - DNA, 200 bp, Conyza canadensis
tcctgcttaactcgagtgctggatccaacccatatcaaaatacgcatgttaccggcgcatctggtctagtcttattccatggatacatgttccgtgttccgttcagaaggttatgtttctaccagaagacagttacaggtactggttaacaagtctattgtaaatcatatacttttacaatggcattgatgtatctgtta

SEQ ID NO: 946 - DNA, 200 bp, Conyza canadensis
taacagatacatcaatgccattgtaaaagtatatgatttacaatagacttgttaaccagtacctgtaactgtcttctggtagaaacataaccttctgaacggaacacggaacatgtatccatggaataagactagaccagatgcgccggtaacatgcgtattttgatatgggttggatccagcactcgagttaagcagga

SEQ ID NO: 947 - DNA, 200 bp, Conyza canadensis
tacaatggcattgatgtatctgttaacatagtggaagatgcggtacaaaggaatatgaacaggcttctttgtgaaagatgtatctattcaacagccagccatagctggaaaaagtgtctctatagtctatatacattaatgcacggtcatcaggtaaaaattcctttgcaaaaaggaaccacaaacaaaaagcaaaggcg

SEQ ID NO: 948 - DNA, 200 bp, Conyza canadensis
cgcctttgctttttgtttgtggttcctttttgcaaaggaatttttacctgatgaccgtgcattaatgtatatagactatagagacactttttccagctatggctggctgttgaatagatacatctttcacaaagaagcctgttcatattcctttgtaccgcatcttccactatgttaacagatacatcaatgccattgta

SEQ ID NO: 949 - DNA, 200 bp, Conyza canadensis
gaaccacaaacaaaaagcaaaggcgagtaaaaaaaaaaaaagaacctaagtgagagattgcctgcacagacaactaattacaatgtacattgactcgcacacttcgcaatgacacaatactctgatttctatatatatgtgtatgtgcatttacatttgccctttattttggtatccgatggttgggcccaacattatgg

SEQ ID NO: 950 - DNA, 200 bp, Conyza canadensis
ccataatgttgggcccaaccatcggataccaaaataaagggcaaatgtaaatgcacatacacatatatatagaaatcagagtattgtgtcattgcgaagtgtgcgagtcaatgtacattgtaattagttgtctgtgcaggcaatctctcacttaggttctttttttttttttactcgcctttgctttttgtttgtggttc

SEQ ID NO: 951 - DNA, 200 bp, Conyza canadensis
ccgatggttgggcccaacattatggagccaatcaaccacttcattaatggttggcctcttgacggggtttacgttcacacacatacaggcgacatcaagaacctgcagcatctcttcttcaaatcccttgtctctcaggatctcatcaaatatttgatcctgtttcccttctattctaagttgttgcacccacacaacca

SEQ ID NO: 952 - DNA, 200 bp, Conyza canadensis
tggttgtgtgggtgcaacaacttagaatagaagggaaacaggatcaaatatttgatgagatcctgagagacaagggatttgaagaagagatgctgcaggttcttgatgtcgcctgtatgtgtgtgaacgtaaaccccgtcaagaggccaaccattaatgaagtggttgattggctccataatgttgggcccaaccatcgg

SEQ ID NO: 953 - DNA, 200 bp, Conyza canadensis
ctaagttgttgcacccacacaaccaattctctagacgcctttggccggaatacctccatgggcctctttcctgtaagcagctcaagcatgacaaccccaaaactgtatatgtcccctctcaaggtggctatccatgactggctgtactccggtggaatataccccagggtgcccaccaactcagtcgtgacgtgtgtatt

SEQ ID NO: 954 - DNA, 200 bp, Conyza canadensis
aatacacacgtcacgactgagttggtgggcaccctggggtatattccaccggagtacagccagtcatggatagccaccttgagaggggacatatacagttttggggttgtcatgcttgagctgcttacaggaaagaggcccatggaggtattccggccaaaggcgtctagagaattggttgtgtgggtgcaacaacttag

SEQ ID NO: 955 - DNA, 200 bp, Conyza canadensis
ccaactcagtcgtgacgtgtgtattgtatggatgaatcaatctagacaatccaaaatcggccacgtatgcttcaaattggtcatccagaaggatgttacttgatttgatgtcacgatgcacgatatgtggttcgcatacttggtgcatataagccagtccacaacttgctccccgggcgatcttcaatctcgttggccaa

SEQ ID NO: 956 - DNA, 200 bp, Conyza canadensis
ttggccaacgagattgaagatcgcccggggagcaagttgtggactggcttatatgcaccaagtatgcgaaccacatatcgtgcatcgtgacatcaaatcaagtaacatccttctggatgaccaatttgaagcatacgtggccgattttggattgtctagattgattcatccatacaatacacacgtcacgactgagttgg

SEQ ID NO: 957 - DNA, 200 bp, Conyza canadensis
ggcgatcttcaatctcgttggccaatcgagcctggatgctccgtcagccttctcatgtagccagtagtccaagcttccattttccatatacgaataaatcagcagctgacatccatcatgtacacagtacccttgtaaagaaaccagatttttgtgatgggcagttgataatgcctccacttctgctttaaactcccttg

SEQ ID NO: 958 - DNA, 200 bp, Conyza canadensis
caagggagtttaaagcagaagtggaggcattatcaactgcccatcacaaaaatctggtttctttacaagggtactgtgtacatgatggatgtcagctgctgatttattcgtatatggaaaatggaagcttggactactggctacatgagaaggctgacggagcatccaggctcgattggccaacgagattgaagatcgcc

SEQ ID NO: 959 - DNA, 200 bp, Conyza canadensis
tccacttctgctttaaactcccttgcaatgaggcccatatctcctgaaagtttcttgacagccagttttgttccgttcgccaaagttgctttgtaaaccaatccaaagcccccacatccaatgatgtttgcttgactgaaatcttcggttgctttcaaaatatcagttatggttagatgtttgatgtcttttgcattgtg

SEQ ID NO: 960 - DNA, 200 bp, Conyza canadensis
cacaatgcaaaagacatcaaacatctaaccataactgatattttgaaagcaaccgaagatttcagtcaagcaaacatcattggatgtgggggctttggattggtttacaaagcaactttggcgaacggaacaaaactggctgtcaagaaactttcaggagatatgggcctcattgcaagggagtttaaagcagaagtgga

SEQ ID NO: 961 - DNA, 200 bp, Conyza canadensis
gatgtttgatgtcttttgcattgtgcgggaacaatatgactccgctggtatccttgggaacctctacggccgacgtagaattgaaggacaccgtgtccatatggaagacttccgggtcacctctggggagaatccttcttttggacaatatccacagtgccagacaagccagagtgatgccaaccccaaaacagatgccc

SEQ ID NO: 962 - DNA, 200 bp, Conyza canadensis
gggcatctgttttggggttggcatcactctggcttgtctggcactgtggatattgtccaaaagaaggattctccccagaggtgacccggaagtcttccatatggacacggtgtccttcaattctacgtcggccgtagaggttcccaaggataccagcggagtcatattgttcccgcacaatgcaaaagacatcaaacatc

SEQ ID NO: 963 - DNA, 200 bp, Conyza canadensis
gatgccaaccccaaaacagatgcccaggatgaggccgacgatgagtttcttgtttgggcctttttcatgtggcgaggaagcgtctgttttgggtgatagaggattattttcatcgttgcaaaggttttgcatgggtggaccgcacaaccctggattgccttcgtagttctggttcaagaaggtgtcaaactgtcccccgg

SEQ ID NO: 964 - DNA, 200 bp, Conyza canadensis
ccgggggacagtttgacaccttcttgaaccagaactacgaaggcaatccagggttgtgcggtccacccatgcaaaacctttgcaacgatgaaaataatcctctatcacccaaaacagacgcttcctcgccacatgaaaaaggcccaaacaagaaactcatcgtcggcctcatcctgggcatctgttttggggttggcatc

SEQ ID NO: 965 - DNA, 200 bp, Conyza canadensis
aagaaggtgtcaaactgtcccccggtcggtatggaaccttgtagcttgttgtaagcgacgttgaaagaagacagaaagtgcaagcttttgagggaggcagggatctgaccagacagattgttatgggagaggtccagcttttccaagtttgtgagatttgaaatggtagcgggaatggagccagagaaattgtttaggct

SEQ ID NO: 966 - DNA, 200 bp, Conyza canadensis
agcctaaacaatttctctggctccattcccgctaccatttcaaatctcacaaacttggaaaagctggacctctcccataacaatctgtctggtcagatccctgcctccctcaaaagcttgcactttctgtcttctttcaacgtcgcttacaacaagctacaaggttccataccgaccgggggacagtttgacaccttctt

SEQ ID NO: 967 - DNA, 200 bp, Conyza canadensis
tggagccagagaaattgtttaggctgagatcaagtgtatgaatggactgcatattaccaatctcaacaggtaggctgccaccgagttgattgcttgacaggtacaatgctggaggcagggtggccagctgattgtactgcaaataggatgcattttgaggggcaacgaatacagggagttccaggtaactgctgtttaca

SEQ ID NO: 968 - DNA, 200 bp, Conyza canadensis
tgtaaacagcagttacctggaactccctgtattcgttgcccctcaaaatgcatcctatttgcagtacaatcagctggccaccctgcctccagcattgtacctgtcaagcaatcaactcggtggcagcctacctgttgagattggtaatatgcagtccattcatacacttgatctcagcctaaacaatttctctggctcca

SEQ ID NO: 969 - DNA, 200 bp, Conyza canadensis
gagttccaggtaactgctgtttacacggtccaaaacctgctgcgatgcgagggctgggagtctggtaagctccacagggaatcccccggatagagaattattagacaggtccagatagaagaggttcggaagcgtgtgtagccagcccggaatgacgccgtcgatattattctgggagaggtcgatgacctccagattgg

SEQ ID NO: 970 - DNA, 200 bp, Conyza canadensis
ccaatctggaggtcatcgacctctcccagaataatatcgacggcgtcattccgggctggctacacacgcttccgaacctcttctatctggacctgtctaataattctctatccgggggattccctgtggagcttaccagactcccagccctcgcatcgcagcaggttttggaccgtgtaaacagcagttacctggaactc

SEQ ID NO: 971 - DNA, 200 bp, Conyza canadensis
gagaggtcgatgacctccagattggtaagggaagagagccacgtggggatctgaccgaacagcttgcagccaccaagacccatgatcttgagattggagaaaccagagatgggttgaggggggaggggttcgttgaagaagttcttggagaggatgagggtggtgagtttcggatgcctgctcaggatattgaatgcgct

SEQ ID NO: 972 - DNA, 200 bp, Conyza canadensis
agcgcattcaatatcctgagcaggcatccgaaactcaccaccctcatcctctccaagaacttcttcaacgaacccctcccccctcaacccatctctggtttctccaatctcaagatcatgggtcttggtggctgcaagctgttcggtcagatccccacgtggctctcttcccttaccaatctggaggtcatcgacctctc

SEQ ID NO: 973 - DNA, 200 bp, Conyza canadensis
gcctgctcaggatattgaatgcgcttgtgatgttcctgagggtgttgtttgaaagggagaggaaggagagagcaggcaggccgaggacatgagcggggatttcccctcgcagcctgttggtggccagccggattgcggtgagcgatttgcaagagaagacggtggccggcagctcccctgcgaatcggttttcgccaagg

SEQ ID NO: 974 - DNA, 200 bp, Conyza canadensis
ccttggcgaaaaccgattcgcaggggagctgccggccaccgtcttctcttgcaaatcgctcaccgcaatccggctggccaccaacaggctgcgaggggaaatccccgctcatgtcctcggcctgcctgctctctccttcctctccctttcaaacaacaccctcaggaacatcacaagcgcattcaatatcctgagcaggc

SEQ ID NO: 975 - DNA, 200 bp, Conyza canadensis
ccctgcgaatcggttttcgccaaggtcaaggatggtgagcctggtgaaaccggagaaatcaaaatccgagagaatgccggtgaaggagttgaccctgagattgagaagctgcagggatttgcagttgacgagggaaggaggaagggttccattgagacggttgatgtgaagttcaagtttctgcaacaaggggaggttgc

SEQ ID NO: 976 - DNA, 200 bp, Conyza canadensis
gcaacctccccttgttgcagaaacttgaacttcacatcaaccgtctcaatggaacccttcctccttccctcgtcaactgcaaatccctgcagcttctcaatctcagggtcaactccttcaccggcattctctcggattttgatttctccggtttcaccaggctcaccatccttgaccttggcgaaaaccgattcgcaggg

SEQ ID NO: 977 - DNA, 200 bp, Conyza canadensis
agtttctgcaacaaggggaggttgccaatggcgtgggggatgggcccgctaaagttgttgccaaacaaggcaagagtggtgaggttggtgagggtggtgatggaatcgggaatggggccggtgagagagttcccagggaacgatagatggcggagggaaggggtggtggaaacgtggaaaggggcaagggcgccggtgag

SEQ ID NO: 978 - DNA, 200 bp, Conyza canadensis
ctcaccggcgcccttgcccctttccacgtttccaccaccccttccctccgccatctatcgttccctgggaactctctcaccggccccattcccgattccatcaccaccctcaccaacctcaccactcttgccttgtttggcaacaactttagcgggcccatcccccacgccattggcaacctccccttgttgcagaaact

SEQ ID NO: 979 - DNA, 200 bp, Conyza canadensis
ggaaaggggcaagggcgccggtgaggttgttaaaccccagactcaaaacctggagggaagcacaggggcccgacaaaggggggaaatccccggtgaagtcgttcaaggagagatcgaggatggtcagattagagttgcatatggtggaggtggggacggggcctgtcaaggtgttgttgctgacattgagggcaatcaaa

SEQ ID NO: 980 - DNA, 200 bp, Conyza canadensis
tttgattgccctcaatgtcagcaacaacaccttgacaggccccgtccccacctccaccatatgcaactctaatctgaccatcctcgatctctccttgaacgacttcaccggggatttcccccctttgtcgggcccctgtgcttccctccaggttttgagtctggggtttaacaacctcaccggcgcccttgcccctttcc

SEQ ID NO: 981 - DNA, 200 bp, Conyza canadensis
gttgctgacattgagggcaatcaaagaagggaaagaagggaagaaggtaggcggaatcgtgccattcagataattactggacagattcagggtggagatggtggtcgtggtgggttgtggcaggttcccagaaagtctgttgtaacttaagtcaacggtgtggagatggttgaaaaattgtggtgggaggggaccagata

SEQ ID NO: 982 - DNA, 200 bp, Conyza canadensis
tatctggtcccctcccaccacaatttttcaaccatctccacaccgttgacttaagttacaacagactttctgggaacctgccacaacccaccacgaccaccatctccaccctgaatctgtccagtaattatctgaatggcacgattccgcctaccttcttcccttctttcccttctttgattgccctcaatgtcagcaac

SEQ ID NO: 983 - DNA, 200 bp, Conyza canadensis
aattgtggtgggaggggaccagataggaaattacaggacaggtttaggaaagatagggatgtcagattttcaagaggggcataataatcattgtaattggtcgtagtaaggcctctatttggtaaggaaatcccgaccacacggtgaccttgatcatcacaactgattccatcccacaaacagcaatcttctccttcccc

SEQ ID NO: 984 - DNA, 200 bp, Conyza canadensis
ggggaaggagaagattgctgtttgtgggatggaatcagttgtgatgatcaaggtcaccgtgtggtcgggatttccttaccaaatagaggccttactacgaccaattacaatgattattatgcccctcttgaaaatctgacatccctatctttcctaaacctgtcctgtaatttcctatctggtcccctcccaccacaatt

SEQ ID NO: 985 - DNA, 200 bp, Conyza canadensis
acaaacagcaatcttctccttccccattggcagcagcccagttgacgacgctgggaaagttgttgccaaaaagcaacagagaatccttatcatcagagttacaagctgctgctgctgtcgtccttgtacaagcaggaaacaacaaaactaacactaacactagtatcatcaacaaacccctccccacatgatcatgctca

SEQ ID NO: 986 - DNA, 200 bp, Conyza canadensis
tgagcatgatcatgtggggaggggtttgttgatgatactagtgttagtgttagttttgttgtttcctgcttgtacaaggacgacagcagcagcagcttgtaactctgatgataaggattctctgttgctttttggcaacaactttcccagcgtcgtcaactgggctgctgccaatggggaaggagaagattgctgtttgt

SEQ ID NO: 987 - DNA, 200 bp, Conyza canadensis
acccctccccacatgatcatgctcacgattatgattgaatgatgaacaacaacacgggaccaacagcatcatcaacaaccaaaccaaaccacaccacaccacccacccacaaacaaacaaagatatatatatatatatatatatatatatattactttttgtttctaaaaagaaagaagaaaattatgaagagaaaaaga

SEQ ID NO: 988 - DNA, 200 bp, Conyza canadensis
tctttttctcttcataattttcttctttctttttagaaacaaaaagtaatatatatatatatatatatatatatatatctttgtttgtttgtgggtgggtggtgtggtgtggtttggtttggttgttgatgatgctgttggtcccgtgttgttgttcatcattcaatcataatcgtgagcatgatcatgtggggaggggt

SEQ ID NO: 989 - DNA, 200 bp, Conyza canadensis
gaagaaaattatgaagagaaaaagacgacgataatggtaataatcccatttcaattcaaagaaagaaagaaaaaatacaagtggatgttgacgcagaccattagtaaaaaaaaaaaaaagagaagggcatcaaatcaaatcaaatcaattgaataaattatataattagaaaaaattacaaatagagagggtgtttctat

SEQ ID NO: 990 - DNA, 200 bp, Conyza canadensis
atagaaacaccctctctatttgtaattttttctaattatataatttattcaattgatttgatttgatttgatgcccttctcttttttttttttttactaatggtctgcgtcaacatccacttgtattttttctttctttctttgaattgaaatgggattattaccattatcgtcgtctttttctcttcataattttcttc

SEQ ID NO: 991 - DNA, 200 bp, Conyza canadensis
ttacaaatagagagggtgtttctattcatttatccattattattattattattattattattattatattattactacttgctactattctattttaattacattattattattaattatgtatgatataatgagagagttgaagaacaactagatattaatcaaatccatccatccatccatcatgacgacgaccaata

SEQ ID NO: 992 - DNA, 200 bp, Conyza canadensis
tattggtcgtcgtcatgatggatggatggatggatttgattaatatctagttgttcttcaactctctcattatatcatacataattaataataataatgtaattaaaatagaatagtagcaagtagtaataatataataataataataataataataataataatggataaatgaatagaaacaccctctctatttgtaa

SEQ ID NO: 993 - DNA, 200 bp, Conyza canadensis
ccatccatcatgacgacgaccaatagagagagagagagagcgcgcgtttactttgtttattttatatgagtagtaagtatttgatgtttttattttaatcaaggaaattactgtaattaaattcaattgacttgaattggtggaaggagggagggtgggggcggctgttcgctcatcagtcatcaccatccatctctcat

SEQ ID NO: 994 - DNA, 200 bp, Conyza canadensis
atgagagatggatggtgatgactgatgagcgaacagccgcccccaccctccctccttccaccaattcaagtcaattgaatttaattacagtaatttccttgattaaaataaaaacatcaaatacttactactcatataaaataaacaaagtaaacgcgcgctctctctctctctctattggtcgtcgtcatgatggatgg

SEQ ID NO: 995 - DNA, 200 bp, Conyza canadensis
tcagtcatcaccatccatctctcatcgtgtcatgatgtatatatatatattatatatatatagagagagagagggagattaataaaatacaaatggacaaatgcaaatgggaattattattattattattatttatttagctttatatggatatggaaatggatggtgtgggcatctcatcaaatcaaatagaatccaac

SEQ ID NO: 996 - DNA, 200 bp, Conyza canadensis
gttggattctatttgatttgatgagatgcccacaccatccatttccatatccatataaagctaaataaataataataataataataattcccatttgcatttgtccatttgtattttattaatctccctctctctctctatatatatataatatatatatatacatcatgacacgatgagagatggatggtgatgactga

SEQ ID NO: 997 - DNA, 200 bp, Conyza canadensis
ctcatcaaatcaaatagaatccaaccattacaagtgcgcctttttccttttctttctaaagtggagagacggattgagtgagggagggactattaccaataccaattataccatggttagtggcggtggtggtacgactattaccaaaactaattataccatcaatatataatcactaatatatatatatatatatatgg

SEQ ID NO: 998 - DNA, 200 bp, Conyza canadensis
ccatatatatatatatatatattagtgattatatattgatggtataattagttttggtaatagtcgtaccaccaccgccactaaccatggtataattggtattggtaatagtccctccctcactcaatccgtctctccactttagaaagaaaaggaaaaaggcgcacttgtaatggttggattctatttgatttgatgag

SEQ ID NO: 999 - DNA, 200 bp, Conyza canadensis
cggagagacttgcctaacacacgaactccaagtacaaattcatcaccatataaaagtgtcacatatgcttcttcttcttcttttgatgatccagctggagctccttccacaattatctcatttaataataataataataatcctactaacccaaaccctaatctcctcaatttcattttttaatctaatagtctgattat

SEQ ID NO: 1000 - DNA, 200 bp, Conyza canadensis
ataatcagactattagattaaaaaatgaaattgaggagattagggtttgggttagtaggattattattattattattaaatgagataattgtggaaggagctccagctggatcatcaaaagaagaagaagaagcatatgtgacacttttatatggtgatgaatttgtacttggagttcgtgtgttaggcaagtctctccg

SEQ ID NO: 1001 - DNA, 200 bp, Conyza canadensis
ttttttaatctaatagtctgattattaagagattataaggagattagaaatgaggtttttgttatacaataagatattattgtatttttaatcttttttaagttttttggaattattttgggggtttatgatagaaattgtggcaactgaatttttggtgggttttttgagaatttgattttaagggctggtgtttgtct

SEQ ID NO: 1002 - DNA, 200 bp, Conyza canadensis
agacaaacaccagcccttaaaatcaaattctcaaaaaacccaccaaaaattcagttgccacaatttctatcataaacccccaaaataattccaaaaaacttaaaaaagattaaaaatacaataatatcttattgtataacaaaaacctcatttctaatctccttataatctcttaataatcagactattagattaaaaaa

SEQ ID NO: 1003 - DNA, 200 bp, Conyza canadensis
tgattttaagggctggtgtttgtctgatcatctgcagcgagctgatagtattattattatgtctctttttggaaatgtctctgccattaacctaactggaaactgtctgctatcaatcactagttccagagatgttttgtcatttcggcacggtgatactatgggttatcgcttgcaatcccccccttcttttattacca

SEQ ID NO: 1004 - DNA, 200 bp, Conyza canadensis
tggtaataaaagaagggggggattgcaagcgataacccatagtatcaccgtgccgaaatgacaaaacatctctggaactagtgattgatagcagacagtttccagttaggttaatggcagagacatttccaaaaagagacataataataatactatcagctcgctgcagatgatcagacaaacaccagcccttaaaatca

SEQ ID NO: 1005 - DNA, 200 bp, Conyza canadensis
caatcccccccttcttttattaccaaaactaacaaaaatgtctcccctttgaaggtagtttgtgtcgactatccaagaccagacctcgataacacctctaatttcttggaagctgcttatttgtcttctaccttccgagcttctccacgcccacctaagccattgaaggttgtaattgctggtgcaggtctcgctggttt

SEQ ID NO: 1006 - DNA, 200 bp, Conyza canadensis
aaaccagcgagacctgcaccagcaattacaaccttcaatggcttaggtgggcgtggagaagctcggaaggtagaagacaaataagcagcttccaagaaattagaggtgttatcgaggtctggtcttggatagtcgacacaaactaccttcaaaggggagacatttttgttagttttggtaataaaagaagggggggattg

SEQ ID NO: 1007 - DNA, 200 bp, Conyza canadensis
ttgctggtgcaggtctcgctggtttatcaactgcaaagtacttggctgatgccggtcacaagccaattttgctagaagcaagagatgttcttggtggaaaggtagctgcctggaaagatgatgatggagattggtacgagactggtttacacatattttttggagcttacccgaatatacagaatctgtttggagagtta

SEQ ID NO: 1008 - DNA, 200 bp, Conyza canadensis
taactctccaaacagattctgtatattcgggtaagctccaaaaaatatgtgtaaaccagtctcgtaccaatctccatcatcatctttccaggcagctacctttccaccaagaacatctcttgcttctagcaaaattggcttgtgaccggcatcagccaagtactttgcagttgataaaccagcgagacctgcaccagcaa

SEQ ID NO: 1009 - DNA, 200 bp, Conyza canadensis
tatacagaatctgtttggagagttaggcattaatgatagattgcagtggaaggagcattcaatgatatttgcgatgccaaacaaacctggagaatttagtcggtttgatttcccagatgttctgccggcaccattgaatggaatttgggctatcttgaggaacaatgaaatgctgacatggcctgagaaagtaaaatttg

SEQ ID NO: 1010 - DNA, 200 bp, Conyza canadensis
caaattttactttctcaggccatgtcagcatttcattgttcctcaagatagcccaaattccattcaatggtgccggcagaacatctgggaaatcaaaccgactaaattctccaggtttgtttggcatcgcaaatatcattgaatgctccttccactgcaatctatcattaatgcctaactctccaaacagattctgtata

SEQ ID NO: 1011 - DNA, 200 bp, Conyza canadensis
acatggcctgagaaagtaaaatttgctatcgggctcttgcctgcaatgttaggtggacaggcttatgttgaggcacaagatggtctgagtgttcaagactggatgagacaacggggcataccagatcgagttactacagaggtgtttattgccatgtcaaaggcattaaacttcatcaatccagatgaactttcaatgca

SEQ ID NO: 1012 - DNA, 200 bp, Conyza canadensis
tgcattgaaagttcatctggattgatgaagtttaatgcctttgacatggcaataaacacctctgtagtaactcgatctggtatgccccgttgtctcatccagtcttgaacactcagaccatcttgtgcctcaacataagcctgtccacctaacattgcaggcaagagcccgatagcaaattttactttctcaggccatgt

SEQ ID NO: 1013 - DNA, 200 bp, Conyza canadensis
tcaatccagatgaactttcaatgcaatgtattctgattgctctgaaccgatttcttcaggagaagcatggttctaagatggcatttttagatggcagcccacctgaaagactttgcatgccaattgttgagcatattgagtcactaggtggccaagtcaggcttaattcacgaatacaaaagatcgagttgaacaaagat

SEQ ID NO: 1014 - DNA, 200 bp, Conyza canadensis
atctttgttcaactcgatcttttgtattcgtgaattaagcctgacttggccacctagtgactcaatatgctcaacaattggcatgcaaagtctttcaggtgggctgccatctaaaaatgccatcttagaaccatgcttctcctgaagaaatcggttcagagcaatcagaatacattgcattgaaagttcatctggattga

SEQ ID NO: 1015 - DNA, 200 bp, Conyza canadensis
acaaaagatcgagttgaacaaagatggaacagttaggaactttttactttatgatggaaatattattgaaggtgatgcttatgtatttgctactccagttgatattctgaagcttctgttgcctgaagattggaaagcaattccttacttcaagaagttggataaattagttggtgtcccagttataaacgttcatatat

SEQ ID NO: 1016 - DNA, 200 bp, Conyza canadensis
atatatgaacgtttataactgggacaccaactaatttatccaacttcttgaagtaaggaattgctttccaatcttcaggcaacagaagcttcagaatatcaactggagtagcaaatacataagcatcaccttcaataatatttccatcataaagtaaaaagttcctaactgttccatctttgttcaactcgatcttttgt

SEQ ID NO: 1017 - DNA, 200 bp, Conyza canadensis
gtcccagttataaacgttcatatatggtttgacaggaaactcaaaaacacctatgatcacctactcttcagcaggagccctcttctcagtgtatatgccgacatgtctgtaacatgcaaggaatactatgatcctaaccggtccatgttagagttggtttttgcacctgcagaagaatggatttcacgcagtgactctga

SEQ ID NO: 1018 - DNA, 200 bp, Conyza canadensis
tcagagtcactgcgtgaaatccattcttctgcaggtgcaaaaaccaactctaacatggaccggttaggatcatagtattccttgcatgttacagacatgtcggcatatacactgagaagagggctcctgctgaagagtaggtgatcataggtgtttttgagtttcctgtcaaaccatatatgaacgtttataactgggac

SEQ ID NO: 1019 - DNA, 200 bp, Conyza canadensis
aatggatttcacgcagtgactctgatattattgacgctacgatgagtgaactttcaagactatttccggatgaaattgcagcagatcagagcaaagcaaaaatattgaaataccatgtagttaaaaccccaaggtcagtttacaaaactgtacctgactgtgaaccttgccgtccattacaaagatctccattagaggga

SEQ ID NO: 1020 - DNA, 200 bp, Conyza canadensis
tccctctaatggagatctttgtaatggacggcaaggttcacagtcaggtacagttttgtaaactgaccttggggttttaactacatggtatttcaatatttttgctttgctctgatctgctgcaatttcatccggaaatagtcttgaaagttcactcatcgtagcgtcaataatatcagagtcactgcgtgaaatccatt

SEQ ID NO: 1021 - DNA, 200 bp, Conyza canadensis
attacaaagatctccattagagggattctatttagctggcgactacacgaaacaaaagtatctggcttcaatggagggtgctgttctatcaggaaaattttgcgcccaagcgattgtaaaggattatgagttgcttgctgccaggagggaagtggttgctgaggcaagccttgtctaactgtatagatgcaagataactt

SEQ ID NO: 1022 - DNA, 200 bp, Conyza canadensis
aagttatcttgcatctatacagttagacaaggcttgcctcagcaaccacttccctcctggcagcaagcaactcataatcctttacaatcgcttgggcgcaaaattttcctgatagaacagcaccctccattgaagccagatacttttgtttcgtgtagtcgccagctaaatagaatccctctaatggagatctttgtaat

SEQ ID NO: 1023 - DNA, 200 bp, Conyza canadensis
taactgtatagatgcaagataacttggtaagttaaaaatcagttgaagacaagagcacgtggttctttgcatatttgactttttatggtccttggctgaagtggtaggcttaaggaggtggcagaatttctgggaggagcttttacaagttcagaagaagctaaacataaatacacccatagcaattcattgttctaact

SEQ ID NO: 1024 - DNA, 200 bp, Conyza canadensis
agttagaacaatgaattgctatgggtgtatttatgtttagcttcttctgaacttgtaaaagctcctcccagaaattctgccacctccttaagcctaccacttcagccaaggaccataaaaagtcaaatatgcaaagaaccacgtgctcttgtcttcaactgatttttaacttaccaagttatcttgcatctatacagtta

SEQ ID NO: 1025 - DNA, 200 bp, Conyza canadensis
tagtgtaatttaattattaatattaagagaatagtgtatgtgaaaatcttttaaaggtttgtaggcttgtagccttgtaggtgaaaatattacataggagggcattttagacatttccccatgtaactttcaacatggagggtattttctttaatatagagtataaataatggagatattttaaaaaaataaaggactga

SEQ ID NO: 1026 - DNA, 200 bp, Conyza canadensis
tcagtcctttatttttttaaaatatctccattatttatactctatattaaagaaaataccctccatgttgaaagttacatggggaaatgtctaaaatgccctcctatgtaatattttcacctacaaggctacaagcctacaaacctttaaaagattttcacatacactattctcttaatattaataattaaattacacta

SEQ ID NO: 1027 - DNA, 200 bp, Conyza canadensis
atattttaaaaaaataaaggactgatagtgtaatttaattattaatattaagagaatagtgtatgtgaaaatgttttaaagggttgtaggtttgtagccttgtaggtgaaaatattacataggaggacattttagacatttaccccatgtaactttcaacatggggggtattttctttaatatagagtataaatatagat

SEQ ID NO: 1028 - DNA, 200 bp, Conyza canadensis
atctatatttatactctatattaaagaaaataccccccatgttgaaagttacatggggtaaatgtctaaaatgtcctcctatgtaatattttcacctacaaggctacaaacctacaaccctttaaaacattttcacatacactattctcttaatattaataattaaattacactatcagtcctttatttttttaaaatat

SEQ ID NO: 1029 - DNA, 200 bp, Conyza canadensis
tttaatatagagtataaatatagataaataatatatattttgtaaattttttaaactaataaattattttaaaataataatttttataaaatatattttatttgataaataataactctaaattacacagatggtacctataatttgtattatattacatgtttcatacctcacatacaagacacgttggctacttaatg

SEQ ID NO: 1030 - DNA, 200 bp, Conyza canadensis
cattaagtagccaacgtgtcttgtatgtgaggtatgaaacatgtaatataatacaaattataggtaccatctgtgtaatttagagttattatttatcaaataaaatatattttataaaaattattattttaaaataatttattagtttaaaaaatttacaaaatatatattatttatctatatttatactctatattaaa

SEQ ID NO: 1031 - DNA, 200 bp, Conyza canadensis
tacaagacacgttggctacttaatgatacaactaacgaccgtcagcgtgaggtatcttctaagtgtaaaattgtaaacatgatataattgacgtaatttaaatctaacaggtatgaaattaataatttcgaccaaaccaaaggtacttaattcactcttaatatactgtatctaatactactcgtggtagtattatgtag

SEQ ID NO: 1032 - DNA, 200 bp, Conyza canadensis
ctacataatactaccacgagtagtattagatacagtatattaagagtgaattaagtacctttggtttggtcgaaattattaatttcatacctgttagatttaaattacgtcaattatatcatgtttacaattttacacttagaagatacctcacgctgacggtcgttagttgtatcattaagtagccaacgtgtcttgta

SEQ ID NO: 1033 - DNA, 200 bp, Conyza canadensis
tactactcgtggtagtattatgtagattcctagcaatggacgacaatattccaacaacataagaagccaaaacccacttccttccttttttttttttgttgttgaataatttaatcagtttttaggaacgaacaacctcctccatttccagataaattattattcagccaagcaaaaaacacaacatcccttgtttcctc

SEQ ID NO: 1034 - DNA, 200 bp, Conyza canadensis
gaggaaacaagggatgttgtgttttttgcttggctgaataataatttatctggaaatggaggaggttgttcgttcctaaaaactgattaaattattcaacaacaaaaaaaaaaaaggaaggaagtgggttttggcttcttatgttgttggaatattgtcgtccattgctaggaatctacataatactaccacgagtagta

SEQ ID NO: 1035 - DNA, 200 bp, Conyza canadensis
aaaacacaacatcccttgtttcctcttcttcttgttttctttttctttctttttgctaaaaaactcacacacgcagaagaagaagacgaagacaaagtcagagagttgagtttggactgattgattgatttgttattaaggtaaaaataccacttactactccatccatccatccatagtagactggtagttgtattagt

SEQ ID NO: 1036 - DNA, 200 bp, Conyza canadensis
actaatacaactaccagtctactatggatggatggatggagtagtaagtggtatttttaccttaataacaaatcaatcaatcagtccaaactcaactctctgactttgtcttcgtcttcttcttctgcgtgtgtgagttttttagcaaaaagaaagaaaaagaaaacaagaagaagaggaaacaagggatgttgtgtttt

SEQ ID NO: 1037 - DNA, 200 bp, Conyza canadensis
atagtagactggtagttgtattagtagtagttagctgctgctttggttattaggattaggatgaagaaactagcagattgttaagtattcttcatgtgactttgttatcttcctttgtaaacaatctcccccaaatataatagcatatcgactaagtggtaatatacttattttttttttaagttgatggtgaactattg

SEQ ID NO: 1038 - DNA, 200 bp, Conyza canadensis
caatagttcaccatcaacttaaaaaaaaaataagtatattaccacttagtcgatatgctattatatttgggggagattgtttacaaaggaagataacaaagtcacatgaagaatacttaacaatctgctagtttcttcatcctaatcctaataaccaaagcagcagctaactactactaatacaactaccagtctactat

SEQ ID NO: 1039 - DNA, 200 bp, Conyza canadensis
tttttaagttgatggtgaactattgtatatggcagggctggtgtttgtctgatcatctgcagcgagctgatagtattattattatgtctctttttggaaatgtctctgccattaacctaactggaaactgtctgctatcaatcactagttccagagatgttttgtcatttcggcacggtgatactatgggttatcgcttg

SEQ ID NO: 1040 - DNA, 200 bp, Conyza canadensis
caagcgataacccatagtatcaccgtgccgaaatgacaaaacatctctggaactagtgattgatagcagacagtttccagttaggttaatggcagagacatttccaaaaagagacataataataatactatcagctcgctgcagatgatcagacaaacaccagccctgccatatacaatagttcaccatcaacttaaaaa

SEQ ID NO: 1041 - DNA, 200 bp, Conyza canadensis
cggtgatactatgggttatcgcttgcaatcccccccttcttttattaccaaaactaacaaaaatgtctcccctttgaaggtacaacctctgccacatgtatttcattatcactcacaaaatcaattctaatgtctttgtttatctgtgctaaacaggtagtttgtgtcgactatccaagaccagacctcgataacacctc

SEQ ID NO: 1042 - DNA, 200 bp, Conyza canadensis
gaggtgttatcgaggtctggtcttggatagtcgacacaaactacctgtttagcacagataaacaaagacattagaattgattttgtgagtgataatgaaatacatgtggcagaggttgtaccttcaaaggggagacatttttgttagttttggtaataaaagaagggggggattgcaagcgataacccatagtatcaccg

SEQ ID NO: 1043 - DNA, 200 bp, Conyza canadensis
caagaccagacctcgataacacctctaatttcttggaagctgcttatttgtcttctaccttccgagcttctccacgcccacctaagccattgaaggttgtaattgctggtgcaggtaaaaccttcatacgtcattatattgtcttttaagtcgcttttgtttgagaatttgatactgccacatctgatagataaccaaat

SEQ ID NO: 1044 - DNA, 200 bp, Conyza canadensis
atttggttatctatcagatgtggcagtatcaaattctcaaacaaaagcgacttaaaagacaatataatgacgtatgaaggttttacctgcaccagcaattacaaccttcaatggcttaggtgggcgtggagaagctcggaaggtagaagacaaataagcagcttccaagaaattagaggtgttatcgaggtctggtcttg

SEQ ID NO: 1045 - DNA, 200 bp, Conyza canadensis
tgccacatctgatagataaccaaatgatacttctagtgtatccccaatgatgctttttatgccacatactaacatctgctttaatttgctatcccacttacttttgcaaacttcgcatatgcaggtctcgctggtttatcaactgcaaagtacttggctgatgccggtcacaagccaattttgctagaagcaagagatgt

SEQ ID NO: 1046 - DNA, 200 bp, Conyza canadensis
acatctcttgcttctagcaaaattggcttgtgaccggcatcagccaagtactttgcagttgataaaccagcgagacctgcatatgcgaagtttgcaaaagtaagtgggatagcaaattaaagcagatgttagtatgtggcataaaaagcatcattggggatacactagaagtatcatttggttatctatcagatgtggca

SEQ ID NO: 1047 - DNA, 200 bp, Conyza canadensis
caattttgctagaagcaagagatgttcttggtggaaaggtaaacgatttataagaaattacaataggatcggaagtcctaggatcccccctccctcttaccttcttctatataacagagcaagcttggtaataaaacaaggattttgggtctaattattctcttctttacttgctttctgttttcgtctctttcactgat

SEQ ID NO: 1048 - DNA, 200 bp, Conyza canadensis
atcagtgaaagagacgaaaacagaaagcaagtaaagaagagaataattagacccaaaatccttgttttattaccaagcttgctctgttatatagaagaaggtaagagggaggggggatcctaggacttccgatcctattgtaatttcttataaatcgtttacctttccaccaagaacatctcttgcttctagcaaaattg

SEQ ID NO: 1049 - DNA, 200 bp, Conyza canadensis
ttctgttttcgtctctttcactgataaccaaaggcaatatcagttagggttctaggatgggtcgaagcaaattttagggataccaatgcctaaccaagttcgatcaagactagggatatagagggtattcaatcagcttctggtgggattatagctcgcgactttgaagctagagttagggttctttaaagcctaacata

SEQ ID NO: 1050 - DNA, 200 bp, Conyza canadensis
tatgttaggctttaaagaaccctaactctagcttcaaagtcgcgagctataatcccaccagaagctgattgaataccctctatatccctagtcttgatcgaacttggttaggcattggtatccctaaaatttgcttcgacccatcctagaaccctaactgatattgcctttggttatcagtgaaagagacgaaaacagaa

SEQ ID NO: 1051 - DNA, 200 bp, Conyza canadensis
ttagggttctttaaagcctaacatagttcaaatacggctggggtgttgggggttcctttctgtacgaatttaaagctggacaaggcagcaaaagagttcgacttgtgtggatttttatctaggtttggctggggtttcaaacaaccgaaggtgtgtttggggttcttgggatagtcgatcaacattggagtgtctttttc

SEQ ID NO: 1052 - DNA, 200 bp, Conyza canadensis
gaaaaagacactccaatgttgatcgactatcccaagaaccccaaacacaccttcggttgtttgaaaccccagccaaacctagataaaaatccacacaagtcgaactcttttgctgccttgtccagctttaaattcgtacagaaaggaacccccaacaccccagccgtatttgaactatgttaggctttaaagaaccctaa

SEQ ID NO: 1053 - DNA, 200 bp, Conyza canadensis
cgatcaacattggagtgtctttttcctgttttacaagttagaatacgtgaaatgcatcttcgttcattattttgcttttgacctttatgtgatgggtacaagtttaacaacctactgcatgcggtttctctttgtgctcacatttcactttctctcttttctcttttgcattgttggggtgggatggctgtttttgctag

SEQ ID NO: 1054 - DNA, 200 bp, Conyza canadensis
ctagcaaaaacagccatcccaccccaacaatgcaaaagagaaaagagagaaagtgaaatgtgagcacaaagagaaaccgcatgcagtaggttgttaaacttgtacccatcacataaaggtcaaaagcaaaataatgaacgaagatgcatttcacgtattctaacttgtaaaacaggaaaaagacactccaatgttgatcg

SEQ ID NO: 1055 - DNA, 200 bp, Conyza canadensis
ggggtgggatggctgtttttgctagtaacatttatacaaacctggacctaatgttaggtcaatccgggctgggttcacaactggatggaggaataagggtcggagggaaatattgaatggctcctcaaacccaaagtaacccagatccaaacacttccaatctaaacaacccagaccccgtggctgctcaatcaacagcc

SEQ ID NO: 1056 - DNA, 200 bp, Conyza canadensis
ggctgttgattgagcagccacggggtctgggttgtttagattggaagtgtttggatctgggttactttgggtttgaggagccattcaatatttccctccgacccttattcctccatccagttgtgaacccagcccggattgacctaacattaggtccaggtttgtataaatgttactagcaaaaacagccatcccacccc

SEQ ID NO: 1057 - DNA, 200 bp, Conyza canadensis
ccccgtggctgctcaatcaacagccatagcatcatctatgaaatcactgcagcaaagaggtagcaatgatcaagacacagtaagccaaacaaaaacagaaatcaagcggcaatttaaatcaatttgaagatgaaggttcatctggtggtaaccaccgtcactacagaccttataataatatcgatttcccaacttttagt

SEQ ID NO: 1058 - DNA, 200 bp, Conyza canadensis
actaaaagttgggaaatcgatattattataaggtctgtagtgacggtggttaccaccagatgaaccttcatcttcaaattgatttaaattgccgcttgatttctgtttttgtttggcttactgtgtcttgatcattgctacctctttgctgcagtgatttcatagatgatgctatggctgttgattgagcagccacgggg

SEQ ID NO: 1059 - DNA, 200 bp, Conyza canadensis
taatatcgatttcccaacttttagtattggagaactgtttacaaggctatgagtattgctatcgagtttgaatccaaggttcacatgaaatttaggaaaagtttttcgtcttcagccaaaacagaatcagtaccttcgaaaccaatagaaacttccaacctgttgccctcgattgctgctgcccagaaaccaactgaagc

SEQ ID NO: 1060 - DNA, 200 bp, Conyza canadensis
gcttcagttggtttctgggcagcagcaatcgagggcaacaggttggaagtttctattggtttcgaaggtactgattctgttttggctgaagacgaaaaacttttcctaaatttcatgtgaaccttggattcaaactcgatagcaatactcatagccttgtaaacagttctccaatactaaaagttgggaaatcgatatta

SEQ ID NO: 1061 - DNA, 200 bp, Conyza canadensis
ctgctgcccagaaaccaactgaagcccgtctttttgatgttaaaaaatagggcagattcatacgagaagttgtgtctaagtttctgatctactcaaaatttctatcaatttgccttgggggaaagccgatgtggtactcggtattcaataattaggaacacttacaaagtttaggcaaaatggaaggagatagtcatgaa

SEQ ID NO: 1062 - DNA, 200 bp, Conyza canadensis
ttcatgactatctccttccattttgcctaaactttgtaagtgttcctaattattgaataccgagtaccacatcggctttcccccaaggcaaattgatagaaattttgagtagatcagaaacttagacacaacttctcgtatgaatctgccctattttttaacatcaaaaagacgggcttcagttggtttctgggcagcag

SEQ ID NO: 1063 - DNA, 200 bp, Conyza canadensis
caaaatggaaggagatagtcatgaagttcactatggatgttaaggagtacaagctacatggacttccaccagatcgtcaaccatcagcaacatttagcgacctcactactgaaccattcgagttacaggcaagtggactagcagctcattttttcacaactggctagtggacaagtcagattttggggccggatgtattg

SEQ ID NO: 1064 - DNA, 200 bp, Conyza canadensis
caatacatccggccccaaaatctgacttgtccactagccagttgtgaaaaaatgagctgctagtccacttgcctgtaactcgaatggttcagtagtgaggtcgctaaatgttgctgatggttgacgatctggtggaagtccatgtagcttgtactccttaacatccatagtgaacttcatgactatctccttccattttg

SEQ ID NO: 1065 - DNA, 200 bp, Conyza canadensis
tcagattttggggccggatgtattgatacaaacctggacccaatgttgggtcaaaccaggtcgggtcagcagctggatggagggaaaaggggtggagggaaatcaagtagtgaaggaattcaagttaggaagtggaccatgcgcccactacatataattgctccactaattttagtattatatatgtgtgtttttctgtt

SEQ ID NO: 1066 - DNA, 200 bp, Conyza canadensis
aacagaaaaacacacatatataatactaaaattagtggagcaattatatgtagtgggcgcatggtccacttcctaacttgaattccttcactacttgatttccctccaccccttttccctccatccagctgctgacccgacctggtttgacccaacattgggtccaggtttgtatcaatacatccggccccaaaatctga

SEQ ID NO: 1067 - DNA, 200 bp, Conyza canadensis
tattatatatgtgtgtttttctgttttttaagctggtcaagatactaagtttgtgattgttcttgtattcggagatttgccatctgaattttgctaatattgtgttagactcagtaatctaaattagtagatttccagtttctatcaaatgttcgtttggcgaaaatgaataattgaagttcatatgacgaccttatttg

SEQ ID NO: 1068 - DNA, 200 bp, Conyza canadensis
caaataaggtcgtcatatgaacttcaattattcattttcgccaaacgaacatttgatagaaactggaaatctactaatttagattactgagtctaacacaatattagcaaaattcagatggcaaatctccgaatacaagaacaatcacaaacttagtatcttgaccagcttaaaaaacagaaaaacacacatatataata

SEQ ID NO: 1069 - DNA, 200 bp, Conyza canadensis
gaagttcatatgacgaccttatttgagcaggatctgttctataggctcgtacctctgtatccttgattcctatcaagacagaaaagtagtttcatatgaaatttctatttttaaacttttgtatatcataagtagtcaagcttagcttaatttcaaatctaggttgtcttagtatgttgttacttatcgtgagtgttttt

SEQ ID NO: 1070 - DNA, 200 bp, Conyza canadensis
aaaaacactcacgataagtaacaacatactaagacaacctagatttgaaattaagctaagcttgactacttatgatatacaaaagtttaaaaatagaaatttcatatgaaactacttttctgtcttgataggaatcaaggatacagaggtacgagcctatagaacagatcctgctcaaataaggtcgtcatatgaacttc

SEQ ID NO: 1071 - DNA, 200 bp, Conyza canadensis
gttgttacttatcgtgagtgtttttatccacattgctcttctcacataggtagctgcctggaaagatgatgatggagattggtacgagactggtttacacatattttgtaagttttaacttcttatatcctttcaagtgtcgaaaaagagagctgatgtgtgcataaaaagttattcccataatataattctcaacaggg

SEQ ID NO: 1072 - DNA, 200 bp, Conyza canadensis
ccctgttgagaattatattatgggaataactttttatgcacacatcagctctctttttcgacacttgaaaggatataagaagttaaaacttacaaaatatgtgtaaaccagtctcgtaccaatctccatcatcatctttccaggcagctacctatgtgagaagagcaatgtggataaaaacactcacgataagtaacaac

SEQ ID NO: 1073 - DNA, 200 bp, Conyza canadensis
tcccataatataattctcaacagggttgttgtcgtctttttgtgcactatctatctgctctaagttattgtttctccacgtacctttccttttggacatttgtcactagacacctaatgtgcaataaacttcttcatttgcttgaagttggagcttacccgaatatacagaatctgtttggagagttaggcattaatgat

SEQ ID NO: 1074 - DNA, 200 bp, Conyza canadensis
atcattaatgcctaactctccaaacagattctgtatattcgggtaagctccaacttcaagcaaatgaagaagtttattgcacattaggtgtctagtgacaaatgtccaaaaggaaaggtacgtggagaaacaataacttagagcagatagatagtgcacaaaaagacgacaacaaccctgttgagaattatattatggga

SEQ ID NO: 1075 - DNA, 200 bp, Conyza canadensis
gtttggagagttaggcattaatgatagattgcagtggaaggagcattcaatgatatttgcgatgccaaacaaacctggagaatttagtcggtttgatttcccagatgttctgccggcaccattgaatggtaagtatgctattattagcctattttttttggtgtatatattttatttaaatgatttggtggtgagcattt

SEQ ID NO: 1076 - DNA, 200 bp, Conyza canadensis
aaatgctcaccaccaaatcatttaaataaaatatatacaccaaaaaaaataggctaataatagcatacttaccattcaatggtgccggcagaacatctgggaaatcaaaccgactaaattctccaggtttgtttggcatcgcaaatatcattgaatgctccttccactgcaatctatcattaatgcctaactctccaaac

SEQ ID NO: 1077 - DNA, 200 bp, Conyza canadensis
ttaaatgatttggtggtgagcattttctgcatcaccaacatgacaaaaaagatctaaaacaagatcagtcagggaatgctagattactaacaaatgtgactctgcataccatctcaggaatttgggctatcttgaggaacaatgaaatgctgacatggcctgagaaagtaaaatttgctatcgggctcttgcctgcaatg

SEQ ID NO: 1078 - DNA, 200 bp, Conyza canadensis
cattgcaggcaagagcccgatagcaaattttactttctcaggccatgtcagcatttcattgttcctcaagatagcccaaattcctgagatggtatgcagagtcacatttgttagtaatctagcattccctgactgatcttgttttagatcttttttgtcatgttggtgatgcagaaaatgctcaccaccaaatcatttaa

SEQ ID NO: 1079 - DNA, 200 bp, Conyza canadensis
tgctatcgggctcttgcctgcaatgttaggtggacaggcttatgttgaggcacaagatggtctgagtgttcaagactggatgagacaacgggtatgtagtcgtttatgtaaatatttcttttaccattttttagtttaatacataagaaacaatggccatgatacctggtatatttgataatggtaacgtttctaagtgg

SEQ ID NO: 1080 - DNA, 200 bp, Conyza canadensis
ccacttagaaacgttaccattatcaaatataccaggtatcatggccattgtttcttatgtattaaactaaaaaatggtaaaagaaatatttacataaacgactacatacccgttgtctcatccagtcttgaacactcagaccatcttgtgcctcaacataagcctgtccacctaacattgcaggcaagagcccgatagca

SEQ ID NO: 1081 - DNA, 200 bp, Conyza canadensis
tgataatggtaacgtttctaagtggaagatccagaggtcaaaccttagcaggggctttttttaggaagattgttggctaattaaaccccctgcttaataattcgagttcttgtttcttttgttatgaattttatttaataattaatgcacatttttcatttttccagggcataccagatcgagttactacagaggtgttt

SEQ ID NO: 1082 - DNA, 200 bp, Conyza canadensis
aaacacctctgtagtaactcgatctggtatgccctggaaaaatgaaaaatgtgcattaattattaaataaaattcataacaaaagaaacaagaactcgaattattaagcagggggtttaattagccaacaatcttcctaaaaaaagcccctgctaaggtttgacctctggatcttccacttagaaacgttaccattatca

SEQ ID NO: 1083 - DNA, 200 bp, Conyza canadensis
agatcgagttactacagaggtgtttattgccatgtcaaaggcattaaacttcatcaatccagatgaactttcaatgcaatgtattctgattgctctgaaccgatttcttcaggtgaaggcatcattctcttagagcttactggttaaataatgatgaaaaattaatctcatgacttttaattccatcttccgtctgtcat

SEQ ID NO: 1084 - DNA, 200 bp, Conyza canadensis
atgacagacggaagatggaattaaaagtcatgagattaatttttcatcattatttaaccagtaagctctaagagaatgatgccttcacctgaagaaatcggttcagagcaatcagaatacattgcattgaaagttcatctggattgatgaagtttaatgcctttgacatggcaataaacacctctgtagtaactcgatct

SEQ ID NO: 1085 - DNA, 200 bp, Conyza canadensis
tttaattccatcttccgtctgtcatatatgataagttggtcacggactcaagtcactaatatattatatggattgattttacgcttgtgattggtcaagtagacaaagcatgcaaagttatatgggtttagtgtaattagtgtctgttgcattgctcactgtatgtctgtattggttgctataagccagcgtgctacctt

SEQ ID NO: 1086 - DNA, 200 bp, Conyza canadensis
aaggtagcacgctggcttatagcaaccaatacagacatacagtgagcaatgcaacagacactaattacactaaacccatataactttgcatgctttgtctacttgaccaatcacaagcgtaaaatcaatccatataatatattagtgacttgagtccgtgaccaacttatcatatatgacagacggaagatggaattaaa

SEQ ID NO: 1087 - DNA, 200 bp, Conyza canadensis
ttgctataagccagcgtgctaccttgaaagcaactctatttccttttccatgatcaagtattattacatatatattgtgcttctagaatccagatacagagatttgggttatttttgtggttttgaaataggagggcggcctctatagttaatctcgaagtgcttattgtacaccatggatttttgaaacaaagagttga

SEQ ID NO: 1088 - DNA, 200 bp, Conyza canadensis
tcaactctttgtttcaaaaatccatggtgtacaataagcacttcgagattaactatagaggccgccctcctatttcaaaaccacaaaaataacccaaatctctgtatctggattctagaagcacaatatatatgtaataatacttgatcatggaaaaggaaatagagttgctttcaaggtagcacgctggcttatagcaa

SEQ ID NO: 1089 - DNA, 200 bp, Conyza canadensis
atggatttttgaaacaaagagttgatcgctcttatctgtagcttcttaacacttcaatattggcttggttgcaatactacatggcatagacattggacaccatagataatacaacttgtaaattgtttgtaataaatcaacaggagaagcatggttctaagatggcatttttagatggcagcccacctgaaagactttgc

SEQ ID NO: 1090 - DNA, 200 bp, Conyza canadensis
gcaaagtctttcaggtgggctgccatctaaaaatgccatcttagaaccatgcttctcctgttgatttattacaaacaatttacaagttgtattatctatggtgtccaatgtctatgccatgtagtattgcaaccaagccaatattgaagtgttaagaagctacagataagagcgatcaactctttgtttcaaaaatccat

SEQ ID NO: 1091 - DNA, 200 bp, Conyza canadensis
tggcagcccacctgaaagactttgcatgccaattgttgagcatattgagtcactaggtggccaagtcaggcttaattcacgaatacaaaagatcgagttgaacaaagatggaacagttaggaactttttactttatgatggaaatattattgaaggtgatgcttatgtatttgctactccaggtacatttagagaacgac

SEQ ID NO: 1092 - DNA, 200 bp, Conyza canadensis
gtcgttctctaaatgtacctggagtagcaaatacataagcatcaccttcaataatatttccatcataaagtaaaaagttcctaactgttccatctttgttcaactcgatcttttgtattcgtgaattaagcctgacttggccacctagtgactcaatatgctcaacaattggcatgcaaagtctttcaggtgggctgcca

SEQ ID NO: 1093 - DNA, 200 bp, Conyza canadensis
actccaggtacatttagagaacgactatttgaatctgtagctttcacatgtctgttggggttgtagctttattgattattttgtgtcaaacagttgatattctgaagcttctgttgcctgaagattggaaagcaattccttacttcaagaagttggataaattagttggtgtcccagttataaacgttcatatatggtta

SEQ ID NO: 1094 - DNA, 200 bp, Conyza canadensis
taaccatatatgaacgtttataactgggacaccaactaatttatccaacttcttgaagtaaggaattgctttccaatcttcaggcaacagaagcttcagaatatcaactgtttgacacaaaataatcaataaagctacaaccccaacagacatgtgaaagctacagattcaaatagtcgttctctaaatgtacctggagt

SEQ ID NO: 1095 - DNA, 200 bp, Conyza canadensis
agttataaacgttcatatatggttagttggatccttcaatataattctaaacatggcacagtaatcattcaccttaatttaatagagtctggcttctgtcttgaccattaatctgacttagtaaaacccctatatgtattctttgtaattgttaaacaccactttcaggtttgacaggaaactcaaaaacacctatgatc

SEQ ID NO: 1096 - DNA, 200 bp, Conyza canadensis
gatcataggtgtttttgagtttcctgtcaaacctgaaagtggtgtttaacaattacaaagaatacatataggggttttactaagtcagattaatggtcaagacagaagccagactctattaaattaaggtgaatgattactgtgccatgtttagaattatattgaaggatccaactaaccatatatgaacgtttataact

SEQ ID NO: 1097 - DNA, 200 bp, Conyza canadensis
aggaaactcaaaaacacctatgatcacctactcttcagcaggtcacctctcaactcttattcttgcaacactattacttaatttttagtagacaaggctgttgagctttttatttgtatgttattcatgccactgctacctaaacggatcttttacttccatttcaaatgtctggggcgtgtcgtccataaaggttctct

SEQ ID NO: 1098 - DNA, 200 bp, Conyza canadensis
agagaacctttatggacgacacgccccagacatttgaaatggaagtaaaagatccgtttaggtagcagtggcatgaataacatacaaataaaaagctcaacagccttgtctactaaaaattaagtaatagtgttgcaagaataagagttgagaggtgacctgctgaagagtaggtgatcataggtgtttttgagtttcct

SEQ ID NO: 1099 - DNA, 200 bp, Conyza canadensis
ggcgtgtcgtccataaaggttctctacagttcatagagtaacttagagtaagcttacaccccacctattaactaaacaaagcaacacaagttaggctatatggtacatgctaaagtgatggtcaagattgcaccatttgctaccgccttgagataccagtgtcccagcttctgcttacacttcatagtttatactcaaat

SEQ ID NO: 1100 - DNA, 200 bp, Conyza canadensis
atttgagtataaactatgaagtgtaagcagaagctgggacactggtatctcaaggcggtagcaaatggtgcaatcttgaccatcactttagcatgtaccatatagcctaacttgtgttgctttgtttagttaataggtggggtgtaagcttactctaagttactctatgaactgtagagaacctttatggacgacacgcc

SEQ ID NO: 1101 - DNA, 200 bp, Conyza canadensis
tacacttcatagtttatactcaaatttaatattggtacaaaaaagagtactgaacctatcagtttagtcttttgtattaattatttagtttgcatgcaggagccctcttctcagtgtatatgccgacatgtctgtaacatgcaaggtaaagacaagacaaacatatatgaaacaaaccattttcttccagacaaacctgc

SEQ ID NO: 1102 - DNA, 200 bp, Conyza canadensis
gcaggtttgtctggaagaaaatggtttgtttcatatatgtttgtcttgtctttaccttgcatgttacagacatgtcggcatatacactgagaagagggctcctgcatgcaaactaaataattaatacaaaagactaaactgataggttcagtactcttttttgtaccaatattaaatttgagtataaactatgaagtgta

SEQ ID NO: 1103 - DNA, 200 bp, Conyza canadensis
accattttcttccagacaaacctgctttgctgttttcatatggttccttgtcatgcaaacaatgaggagatggatgtctattggcctctcctctcattcctattttcccggaaaatgggttaaatctgtctttgtaattttatctttgtcgcatgcatgggacataacttctcacaatgcacataactcaaatatttacc

SEQ ID NO: 1104 - DNA, 200 bp, Conyza canadensis
ggtaaatatttgagttatgtgcattgtgagaagttatgtcccatgcatgcgacaaagataaaattacaaagacagatttaacccattttccgggaaaataggaatgagaggagaggccaatagacatccatctcctcattgtttgcatgacaaggaaccatatgaaaacagcaaagcaggtttgtctggaagaaaatggt

SEQ ID NO: 1105 - DNA, 200 bp, Conyza canadensis
aatgcacataactcaaatatttaccaaaacctcccgcatttttaaaaccaggctatatataagttgtaaattacatgatgtgaacccatacctcccatcaaggttgttctgataatagtgctcccattttatacaggaatactatgatcctaaccggtccatgttagagttggtttttgcacctgcagaagaatggattt

SEQ ID NO: 1106 - DNA, 200 bp, Conyza canadensis
aaatccattcttctgcaggtgcaaaaaccaactctaacatggaccggttaggatcatagtattcctgtataaaatgggagcactattatcagaacaaccttgatgggaggtatgggttcacatcatgtaatttacaacttatatatagcctggttttaaaaatgcgggaggttttggtaaatatttgagttatgtgcatt

SEQ ID NO: 1107 - DNA, 200 bp, Conyza canadensis
tttgcacctgcagaagaatggatttcacgcagtgactctgatattattgacgctacgatgagtgaactttcaagactatttccggatgaaattgcagcagatcagagcaaagcaaaaatattgaaataccatgtagttaaaaccccaaggttagaaatatcttaccagtaaggggttttcaacgattcggtttacgagct

SEQ ID NO: 1108 - DNA, 200 bp, Conyza canadensis
agctcgtaaaccgaatcgttgaaaaccccttactggtaagatatttctaaccttggggttttaactacatggtatttcaatatttttgctttgctctgatctgctgcaatttcatccggaaatagtcttgaaagttcactcatcgtagcgtcaataatatcagagtcactgcgtgaaatccattcttctgcaggtgcaaa

SEQ ID NO: 1109 - DNA, 200 bp, Conyza canadensis
ttttcaacgattcggtttacgagctcttcgctttggtttccttgatttgacaatccttgaagctcaaaccaaaaaccaaatcaaaccgaattaatcagaaacaagccaaaccaaataagatggtttggttttggttcgaatgcgattgaaaccaaaccattttcaaataatgcagattttatgctggcaaatgttatcta

SEQ ID NO: 1110 - DNA, 200 bp, Conyza canadensis
tagataacatttgccagcataaaatctgcattatttgaaaatggtttggtttcaatcgcattcgaaccaaaaccaaaccatcttatttggtttggcttgtttctgattaattcggtttgatttggtttttggtttgagcttcaaggattgtcaaatcaaggaaaccaaagcgaagagctcgtaaaccgaatcgttgaaaa

SEQ ID NO: 1111 - DNA, 200 bp, Conyza canadensis
attttatgctggcaaatgttatctaaactttttggcaaatgaaaatttgctgagattcatttaccaccaaaaacttactatatgaaaagaaatatataatgtattataaacttacattataagttattttaaattaatttgataggaaatatatatatatatatatacacacacatgtatatatatatagaccaattcgg

SEQ ID NO: 1112 - DNA, 200 bp, Conyza canadensis
ccgaattggtctatatatatatacatgtgtgtgtatatatatatatatatatttcctatcaaattaatttaaaataacttataatgtaagtttataatacattatatatttcttttcatatagtaagtttttggtggtaaatgaatctcagcaaattttcatttgccaaaaagtttagataacatttgccagcataaaat

SEQ ID NO: 1113 - DNA, 200 bp, Conyza canadensis
tgtatatatatatagaccaattcggttttcgaattggttttgtttaaaaagcaacaactcgtaaatcaaattatcaaaccataaaccgaatttcaaaatcaatttgttgtcaaaccaaactaaaaactcaaaaaaaccaaatgaatttcaataaatttttatttcaatttggtttgataattggtttcatcgacttggat

SEQ ID NO: 1114 - DNA, 200 bp, Conyza canadensis
atccaagtcgatgaaaccaattatcaaaccaaattgaaataaaaatttattgaaattcatttggtttttttgagtttttagtttggtttgacaacaaattgattttgaaattcggtttatggtttgataatttgatttacgagttgttgctttttaaacaaaaccaattcgaaaaccgaattggtctatatatatataca

SEQ ID NO: 1115 - DNA, 200 bp, Conyza canadensis
gataattggtttcatcgacttggatccgtacactgaacacccctacttacatgtactagtactttctgtagattacttagcatgtgaacaccttcatgtttcacccatctgtgaacgttgtaaacttaatttttgtacagttgtatctgcgatatatactagtttgtgacccaatagatagatttattaattatcatata

SEQ ID NO: 1116 - DNA, 200 bp, Conyza canadensis
tatatgataattaataaatctatctattgggtcacaaactagtatatatcgcagatacaactgtacaaaaattaagtttacaacgttcacagatgggtgaaacatgaaggtgttcacatgctaagtaatctacagaaagtactagtacatgtaagtaggggtgttcagtgtacggatccaagtcgatgaaaccaattatc

SEQ ID NO: 1117 - DNA, 200 bp, Conyza canadensis
agatagatttattaattatcatatagttatgtaattatatttccatgtattgtttattctatttcataattgtgtaacaggtcagtttacaaaactgtacctgactgtgaaccttgccgtccattacaaagatctccattagagggattctatttagctggcgactacacgaaacaaaagtatctggcttcaatggaggg

SEQ ID NO: 1118 - DNA, 200 bp, Conyza canadensis
ccctccattgaagccagatacttttgtttcgtgtagtcgccagctaaatagaatccctctaatggagatctttgtaatggacggcaaggttcacagtcaggtacagttttgtaaactgacctgttacacaattatgaaatagaataaacaatacatggaaatataattacataactatatgataattaataaatctatct

SEQ ID NO: 1119 - DNA, 200 bp, Conyza canadensis
aaaagtatctggcttcaatggagggtgctgttctatcaggaaaattttgcgcccaagcgattgtaaaggtaatgttaaagcaactcgtagctggtagttttagaattatttagcaagtgaaagtatttttctctgctgctttttagagtagtgcaatttgcagcagacgaattttgggtatgtgtttataagtgaccata

SEQ ID NO: 1120 - DNA, 200 bp, Conyza canadensis
tatggtcacttataaacacatacccaaaattcgtctgctgcaaattgcactactctaaaaagcagcagagaaaaatactttcacttgctaaataattctaaaactaccagctacgagttgctttaacattacctttacaatcgcttgggcgcaaaattttcctgatagaacagcaccctccattgaagccagatactttt

SEQ ID NO: 1121 - DNA, 200 bp, Conyza canadensis
gggtatgtgtttataagtgaccataaaaagacaaagtagcctacatattctgttgctcatcttctgatgcatcatgtaacacaggattatgagttgcttgctgccaggagggaagtggttgctgaggcaagccttgtctaactgtatagatgcaagataacttggtaagttaaaaatcagttgaagacaagagcacgtgg

SEQ ID NO: 1122 - DNA, 200 bp, Conyza canadensis
ccacgtgctcttgtcttcaactgatttttaacttaccaagttatcttgcatctatacagttagacaaggcttgcctcagcaaccacttccctcctggcagcaagcaactcataatcctgtgttacatgatgcatcagaagatgagcaacagaatatgtaggctactttgtctttttatggtcacttataaacacataccc

SEQ ID NO: 1123 - DNA, 200 bp, Conyza canadensis
atcagttgaagacaagagcacgtggttctttgcatatttgactttttatggtccttggctgaagtggtaggcttaaggaggtggcagaatttctgggaggagcttttacaagttcagaagaagctaaacataaatacacccatagcaattcattgttctaactgaaacttatttcatatttgtcaaagaaaaaaatacat

SEQ ID NO: 1124 - DNA, 200 bp, Conyza canadensis
atgtatttttttctttgacaaatatgaaataagtttcagttagaacaatgaattgctatgggtgtatttatgtttagcttcttctgaacttgtaaaagctcctcccagaaattctgccacctccttaagcctaccacttcagccaaggaccataaaaagtcaaatatgcaaagaaccacgtgctcttgtcttcaactgat

SEQ ID NO: 1125 - DNA, 200 bp, Conyza canadensis
atatttgtcaaagaaaaaaatacatattcctgttatgtacatagttggttattttcccttgttttatacgtcatgtgtggcatcgaatctattgattatctatacgtattatatgtggcatgtttttttttaattttgcatcctgatctttgattacacttttcaagatttattcactttgcttccatggcatacaagaa

SEQ ID NO: 1126 - DNA, 200 bp, Conyza canadensis
ttcttgtatgccatggaagcaaagtgaataaatcttgaaaagtgtaatcaaagatcaggatgcaaaattaaaaaaaaacatgccacatataatacgtatagataatcaatagattcgatgccacacatgacgtataaaacaagggaaaataaccaactatgtacataacaggaatatgtatttttttctttgacaaatat

SEQ ID NO: 1127 - DNA, 200 bp, Conyza canadensis
actttgcttccatggcatacaagaaaacaatatcaatacagcgagctatctattatctaacttgggagatgcaggtgcatgagaagtgctcaaaacttcaactacttggtgggattaagttgaagtgacactaacccaggtaccaacctcatcccgaaaatctgtgaatattttctttttattcgtcttagttaaaaaaa

SEQ ID NO: 1128 - DNA, 200 bp, Conyza canadensis
tttttttaactaagacgaataaaaagaaaatattcacagattttcgggatgaggttggtacctgggttagtgtcacttcaacttaatcccaccaagtagttgaagttttgagcacttctcatgcacctgcatctcccaagttagataatagatagctcgctgtattgatattgttttcttgtatgccatggaagcaaagt

SEQ ID NO: 1129 - DNA, 200 bp, Conyza canadensis
tttttattcgtcttagttaaaaaaagaaaaaaaagaaacagatgatgcaccagttcaatactttttgttcgataccttgattatttaccaaatgagacacactgtatgtctgtatgtgctttcatcttgtttcattttgtgggaatgtggagtaacaggtataagaatagcaataacacaagtctagttgctgaagagtg

SEQ ID NO: 1130 - DNA, 200 bp, Conyza canadensis
cactcttcagcaactagacttgtgttattgctattcttatacctgttactccacattcccacaaaatgaaacaagatgaaagcacatacagacatacagtgtgtctcatttggtaaataatcaaggtatcgaacaaaaagtattgaactggtgcatcatctgtttcttttttttctttttttaactaagacgaataaaaa

SEQ ID NO: 1131 - DNA, 200 bp, Conyza canadensis
acacaagtctagttgctgaagagtgtgagcagagtaagattttggtatgataccaagtaaagtaaatgcgtagagagtaaggtttaggtgattccttaatgaaatgggaaccttgtgattgtcaatgagttattaatccattgaatttgaaatttcacaacgtgaaataacttgtgctcttacaaaatgttttgtggtca

SEQ ID NO: 1132 - DNA, 200 bp, Conyza canadensis
tgaccacaaaacattttgtaagagcacaagttatttcacgttgtgaaatttcaaattcaatggattaataactcattgacaatcacaaggttcccatttcattaaggaatcacctaaaccttactctctacgcatttactttacttggtatcataccaaaatcttactctgctcacactcttcagcaactagacttgtgt

SEQ ID NO: 1133 - DNA, 200 bp, Conyza canadensis
gctcttacaaaatgttttgtggtcatatatttaccaatacatgtgtcttcttggacactaaaaaaaatagatagctggtgaagatactatataatttaataataagataagatagcgtctactttgctgaaaagtcaaaactggattaccaaatctcattctcacgtgtcaaaatttgacaggatcttttgaaattcact

SEQ ID NO: 1134 - DNA, 200 bp, Conyza canadensis
agtgaatttcaaaagatcctgtcaaattttgacacgtgagaatgagatttggtaatccagttttgacttttcagcaaagtagacgctatcttatcttattattaaattatatagtatcttcaccagctatctattttttttagtgtccaagaagacacatgtattggtaaatatatgaccacaaaacattttgtaagagc

SEQ ID NO: 1135 - DNA, 200 bp, Conyza canadensis
ttgacaggatcttttgaaattcacttgttggacattggcactggatcatgcaaagggatcacatttctcttcaagccttatcccattcccagctatagataccataaatataaacgctggaagtgcagtattgaattacctgatttatgtttttggatgtggggggttttaggaggtgatatgtaatcaaaaacttaacc

SEQ ID NO: 1136 - DNA, 200 bp, Conyza canadensis
ggttaagtttttgattacatatcacctcctaaaaccccccacatccaaaaacataaatcaggtaattcaatactgcacttccagcgtttatatttatggtatctatagctgggaatgggataaggcttgaagagaaatgtgatccctttgcatgatccagtgccaatgtccaacaagtgaatttcaaaagatcctgtcaa

SEQ ID NO: 1137 - DNA, 200 bp, Conyza canadensis
gtgatatgtaatcaaaaacttaacccaatccattcaaagattgtgtgttgtgatatgacctaaagaaagtgagagagagagagattattcttaattctaaagtaataaattgtgaaggcaaataagccgacagcatgttcctgatacacatatccatcacaacatcccctcccaactttgtcacttccattttactccac

SEQ ID NO: 1138 - DNA, 200 bp, Conyza canadensis
gtggagtaaaatggaagtgacaaagttgggaggggatgttgtgatggatatgtgtatcaggaacatgctgtcggcttatttgccttcacaatttattactttagaattaagaataatctctctctctctcactttctttaggtcatatcacaacacacaatctttgaatggattgggttaagtttttgattacatatcac

SEQ ID NO: 1139 - DNA, 200 bp, Conyza canadensis
ctttgtcacttccattttactccacactatatatacgcacacctctttcaacaatggcttctactgtacagaacatccccacttttttgagctttttcacggtgtctgcatgaagttaagagtttgacatctgctcgcattcaccccccctttggccttgatttcttcccacatataacttcaaacttaattaatgaatt

SEQ ID NO: 1140 - DNA, 200 bp, Conyza canadensis
aattcattaattaagtttgaagttatatgtgggaagaaatcaaggccaaagggggggtgaatgcgagcagatgtcaaactcttaacttcatgcagacaccgtgaaaaagctcaaaaaagtggggatgttctgtacagtagaagccattgttgaaagaggtgtgcgtatatatagtgtggagtaaaatggaagtgacaaag

SEQ ID NO: 1141 - DNA, 200 bp, Conyza canadensis
taacttcaaacttaattaatgaattgaatgcgacccgactcttttccatgcaaatcagtggtcacttatcaatgttgattgttgactcgatcccatctataaataccccttcttaccattttctctctcagggtcccagctccacatctgtgaggctttttttcttttggtcccaaatctttcaaaaaaacacaaacaga

SEQ ID NO: 1142 - DNA, 200 bp, Conyza canadensis
tctgtttgtgtttttttgaaagatttgggaccaaaagaaaaaaagcctcacagatgtggagctgggaccctgagagagaaaatggtaagaaggggtatttatagatgggatcgagtcaacaatcaacattgataagtgaccactgatttgcatggaaaagagtcgggtcgcattcaattcattaattaagtttgaagtta

SEQ ID NO: 1143 - DNA, 200 bp, Conyza canadensis
aatctttcaaaaaaacacaaacagaaaatggcaacagctttacaaacaaagatagaagggaatcgtattacaacaaagtgtgcttccttagtaaagaaacagcgagctcgtatatatatcctacgtcgttgtgccaccatgcttctctgctggtacattcaaggagatgaataaatagttgatgctatgacacaaacaac

SEQ ID NO: 1144 - DNA, 200 bp, Conyza canadensis
gttgtttgtgtcatagcatcaactatttattcatctccttgaatgtaccagcagagaagcatggtggcacaacgacgtaggatatatatacgagctcgctgtttctttactaaggaagcacactttgttgtaatacgattcccttctatctttgtttgtaaagctgttgccattttctgtttgtgtttttttgaaagatt

SEQ ID NO: 1145 - DNA, 200 bp, Conyza canadensis
tagttgatgctatgacacaaacaacagacatgtttttatcctcgattcttatagtctctatatcccttttttcacatcaactcatgtggctcccgttttcggttcttttctttggcttatacatattcttaaatatgcatgccctaaacttccatctttttaacaccaacggtccgttgcatttaaaggctgttgggtct

SEQ ID NO: 1146 - DNA, 200 bp, Conyza canadensis
agacccaacagcctttaaatgcaacggaccgttggtgttaaaaagatggaagtttagggcatgcatatttaagaatatgtataagccaaagaaaagaaccgaaaacgggagccacatgagttgatgtgaaaaaagggatatagagactataagaatcgaggataaaaacatgtctgttgtttgtgtcatagcatcaacta

SEQ ID NO: 1147 - DNA, 200 bp, Conyza canadensis
gttgcatttaaaggctgttgggtcttgtctcattttctactccctagtttttgtcatgtcttgtttatcttgacctctcttcatttgtcctgtttaaaacactttttttatccaaatggttttcatttgggttttttgggcatctgcatcagaggacaatttcaactttagacatggaccagaaacggggatatgaccag

SEQ ID NO: 1148 - DNA, 200 bp, Conyza canadensis
ctggtcatatccccgtttctggtccatgtctaaagttgaaattgtcctctgatgcagatgcccaaaaaacccaaatgaaaaccatttggataaaaaaagtgttttaaacaggacaaatgaagagaggtcaagataaacaagacatgacaaaaactagggagtagaaaatgagacaagacccaacagcctttaaatgcaac

SEQ ID NO: 1149 - DNA, 200 bp, Conyza canadensis
ggaccagaaacggggatatgaccagcatgaaggaagcaatcttgcatcaagttggcagcttgaaatgaaggttctacaataacatcttgcgttgtgtcatggtttgtagataattgtctccgctgaaaataaatgacggttcctcacttccttgatatgtaaagcactcataaaatgattaataattcggtgctgctaca

SEQ ID NO: 1150 - DNA, 200 bp, Conyza canadensis
tgtagcagcaccgaattattaatcattttatgagtgctttacatatcaaggaagtgaggaaccgtcatttattttcagcggagacaattatctacaaaccatgacacaacgcaagatgttattgtagaaccttcatttcaagctgccaacttgatgcaagattgcttccttcatgctggtcatatccccgtttctggtcc

SEQ ID NO: 1151 - DNA, 200 bp, Conyza canadensis
tgattaataattcggtgctgctacaaatatatatgttgaagcgcactaaatctgaagttgtgatttattcatcgggatgtttttttctttttaataatgactttttcatcatttaagttgacatatacagcacccactaatgctaatatcttaaatctccacatttcccttgcaatcaccaagacaacttgctgttagca

SEQ ID NO: 1152 - DNA, 200 bp, Conyza canadensis
tgctaacagcaagttgtcttggtgattgcaagggaaatgtggagatttaagatattagcattagtgggtgctgtatatgtcaacttaaatgatgaaaaagtcattattaaaaagaaaaaaacatcccgatgaataaatcacaacttcagatttagtgcgcttcaacatatatatttgtagcagcaccgaattattaatca

SEQ ID NO: 1153 - DNA, 200 bp, Conyza canadensis
tcaccaagacaacttgctgttagcataaccagacactgctactaactttaaccatcaaaagcacataatcccgcaggtcttcaaatccaaatgaggccggacatcatagaacttgtaattttaactcacatagaagtttgatagtgtgatatatgacaagggcagatggtaataagtagagctagcaaatccttttcata

SEQ ID NO: 1154 - DNA, 200 bp, Conyza canadensis
tatgaaaaggatttgctagctctacttattaccatctgcccttgtcatatatcacactatcaaacttctatgtgagttaaaattacaagttctatgatgtccggcctcatttggatttgaagacctgcgggattatgtgcttttgatggttaaagttagtagcagtgtctggttatgctaacagcaagttgtcttggtga

SEQ ID NO: 1155 - DNA, 200 bp, Conyza canadensis
gtagagctagcaaatccttttcatattgttaatcctctctcaaaatggacgaggaagctctaaaactgcagaaaacaaacttttacaaacgaatttaaagctttaagagggaataaggaacaggcatgtcattgaagaatgctatctatttattatggaagatctgtgaccttaaaatcccataaatatgatatgtgtcg

SEQ ID NO: 1156 - DNA, 200 bp, Conyza canadensis
cgacacatatcatatttatgggattttaaggtcacagatcttccataataaatagatagcattcttcaatgacatgcctgttccttattccctcttaaagctttaaattcgtttgtaaaagtttgttttctgcagttttagagcttcctcgtccattttgagagaggattaacaatatgaaaaggatttgctagctctac

SEQ ID NO: 1157 - DNA, 200 bp, Conyza canadensis
aatcccataaatatgatatgtgtcggatcgtccagaatgaaaagtagctcaagttgttagaaatgttaagtagacacagatgttgtatggaactatggaagttcacttatctactgtaatgagcttccatctctcccaatgaattccaaaaccctgactcaccttcaaattaattccagctcgtgaaccaaatttgtgat

SEQ ID NO: 1158 - DNA, 200 bp, Conyza canadensis
atcacaaatttggttcacgagctggaattaatttgaaggtgagtcagggttttggaattcattgggagagatggaagctcattacagtagataagtgaacttccatagttccatacaacatctgtgtctacttaacatttctaacaacttgagctacttttcattctggacgatccgacacatatcatatttatgggatt

SEQ ID NO: 1159 - DNA, 200 bp, Conyza canadensis
ccagctcgtgaaccaaatttgtgattctggacaccaacccttatcaaagaatttaattaaattggcaattgacttgagatgtttgaaattcaattttagagaatagaagtttcatacaatcaacgaatgaactttattacatctgtgtattttaacagcgtacgtttcctgcttaactcgagtgctggatccaacccata

SEQ ID NO: 1160 - DNA, 200 bp, Conyza canadensis
tatgggttggatccagcactcgagttaagcaggaaacgtacgctgttaaaatacacagatgtaataaagttcattcgttgattgtatgaaacttctattctctaaaattgaatttcaaacatctcaagtcaattgccaatttaattaaattctttgataagggttggtgtccagaatcacaaatttggttcacgagctgg

SEQ ID NO: 1161 - DNA, 200 bp, Conyza canadensis
actcgagtgctggatccaacccatatcaaaatacgcatgttaccggcgcatctggtctagtctgattccatggatacatgttccgtgttccgttcagaaggttatgtttctaccagaagacagttacaggtactggttaacaagtctattgtaaatcatatacttttacaatggcattgatgtatctgttaacatagtgg

SEQ ID NO: 1162 - DNA, 200 bp, Conyza canadensis
ccactatgttaacagatacatcaatgccattgtaaaagtatatgatttacaatagacttgttaaccagtacctgtaactgtcttctggtagaaacataaccttctgaacggaacacggaacatgtatccatggaatcagactagaccagatgcgccggtaacatgcgtattttgatatgggttggatccagcactcgagt

SEQ ID NO: 1163 - DNA, 200 bp, Conyza canadensis
attgatgtatctgttaacatagtggaagatgcggtacaaaggaatatgaacaggcttctttgtgaaagatgtatctattcaacagccagccatagctggaaaaagtgtctctatagtctatatacattaatgcacggtcatcaggtaaaaattcctttgcaaaaaggaaccacaaacaaaaagcaaaggcgagtaaaaaa

SEQ ID NO: 1164 - DNA, 200 bp, Conyza canadensis
ttttttactcgcctttgctttttgtttgtggttcctttttgcaaaggaatttttacctgatgaccgtgcattaatgtatatagactatagagacactttttccagctatggctggctgttgaatagatacatctttcacaaagaagcctgttcatattcctttgtaccgcatcttccactatgttaacagatacatcaat

SEQ ID NO: 1165 - DNA, 200 bp, Conyza canadensis
acaaaaagcaaaggcgagtaaaaaaaaaaaagaacctaagtgagagattgcctgcacagacaactaattacaatgtacattgactcgcacacttcgcaatgacacaatactctgatttctatatatatgtgtatgtgcatttacatttgccctttattttggtatccgatggttgggcccaacattatggagccaatcaa

SEQ ID NO: 1166 - DNA, 200 bp, Conyza canadensis
ttgattggctccataatgttgggcccaaccatcggataccaaaataaagggcaaatgtaaatgcacatacacatatatatagaaatcagagtattgtgtcattgcgaagtgtgcgagtcaatgtacattgtaattagttgtctgtgcaggcaatctctcacttaggttcttttttttttttactcgcctttgctttttgt

SEQ ID NO: 1167 - DNA, 200 bp, Conyza canadensis
ggcccaacattatggagccaatcaaccacttcattaatggttggcctcttgacggggtttacgttcacacacatacaggcgacatcaagaacctgcagcatctcttcttcaaatcccttgtctctcaggatctcatcaaatatttgatcctgtttcccttctattctaagttgttgcacccacacaaccaattctctaga

SEQ ID NO: 1168 - DNA, 200 bp, Conyza canadensis
tctagagaattggttgtgtgggtgcaacaacttagaatagaagggaaacaggatcaaatatttgatgagatcctgagagacaagggatttgaagaagagatgctgcaggttcttgatgtcgcctgtatgtgtgtgaacgtaaaccccgtcaagaggccaaccattaatgaagtggttgattggctccataatgttgggcc

SEQ ID NO: 1169 - DNA, 200 bp, Conyza canadensis
gcacccacacaaccaattctctagacgcctttggccggaatacctccatgggcctctttcctgtaagcagctcaagcatgacaaccccaaaactgtatatgtcccctctcaaggtggctatccatgactggctgtactccggtggaatataccccagggtgcccaccaactcagtcgtgacgtgtgtattgtatggatga

SEQ ID NO: 1170 - DNA, 200 bp, Conyza canadensis
tcatccatacaatacacacgtcacgactgagttggtgggcaccctggggtatattccaccggagtacagccagtcatggatagccaccttgagaggggacatatacagttttggggttgtcatgcttgagctgcttacaggaaagaggcccatggaggtattccggccaaaggcgtctagagaattggttgtgtgggtgc

SEQ ID NO: 1171 - DNA, 200 bp, Conyza canadensis
cgtgacgtgtgtattgtatggatgaatcaatctagacaatccaaaatcggccacgtatgcttcaaattggtcatccagaaggatgttacttgatttgatgtcacgatgcacgatatgtggttcgcatacttggtgcatataagccagtccacaacttgctccccgggcgatcttcaatctcgttggccaatcgagcctgg

SEQ ID NO: 1172 - DNA, 200 bp, Conyza canadensis
ccaggctcgattggccaacgagattgaagatcgcccggggagcaagttgtggactggcttatatgcaccaagtatgcgaaccacatatcgtgcatcgtgacatcaaatcaagtaacatccttctggatgaccaatttgaagcatacgtggccgattttggattgtctagattgattcatccatacaatacacacgtcacg

SEQ ID NO: 1173 - DNA, 200 bp, Conyza canadensis
aatctcgttggccaatcgagcctggatgctccgtcagccttctcatgtagccagtagtccaagcttccattttccatatacgaataaatcagcagctgacatccatcatgtacacagtacccttgtaaagaaaccagatttttgtgatgggcagttgataatgcctccacttctgctttaaactcccttgcaatgaggcc

SEQ ID NO: 1174 - DNA, 200 bp, Conyza canadensis
ggcctcattgcaagggagtttaaagcagaagtggaggcattatcaactgcccatcacaaaaatctggtttctttacaagggtactgtgtacatgatggatgtcagctgctgatttattcgtatatggaaaatggaagcttggactactggctacatgagaaggctgacggagcatccaggctcgattggccaacgagatt

SEQ ID NO: 1175 - DNA, 200 bp, Conyza canadensis
ctttaaactcccttgcaatgaggcccatatctcctgaaagtttcttgacagccagttttgttccgttcgccaaagttgctttgtaaaccaatccaaagcccccacatccaatgatgtttgcttgactgaaatcttcggttgctttcaaaatatcagttatggttagatgtttgatgtcttttgcattgtgcgggaacaat

SEQ ID NO: 1176 - DNA, 200 bp, Conyza canadensis
attgttcccgcacaatgcaaaagacatcaaacatctaaccataactgatattttgaaagcaaccgaagatttcagtcaagcaaacatcattggatgtgggggctttggattggtttacaaagcaactttggcgaacggaacaaaactggctgtcaagaaactttcaggagatatgggcctcattgcaagggagtttaaag

SEQ ID NO: 1177 - DNA, 200 bp, Conyza canadensis
gtcttttgcattgtgcgggaacaatatgactccgctggtatccttgggaacctctacggccgacgtagaattgaaggacaccgtgtccatatggaagacttccgggtcacctctggggagaatccttcttttggacaatatccacagtgccagacaagccagagtgatgccaaccccaaaacagatgcccaggatgaggc

SEQ ID NO: 1178 - DNA, 200 bp, Conyza canadensis
gcctcatcctgggcatctgttttggggttggcatcactctggcttgtctggcactgtggatattgtccaaaagaaggattctccccagaggtgacccggaagtcttccatatggacacggtgtccttcaattctacgtcggccgtagaggttcccaaggataccagcggagtcatattgttcccgcacaatgcaaaagac

SEQ ID NO: 1179 - DNA, 200 bp, Conyza canadensis
ccaaaacagatgcccaggatgaggccgacgatgagtttcttgtttgggcctttttcatgtggcgaggaagcgtctgttttgggtgatagaggattattttcatcgttgcaaaggttttgcatgggtggaccgcacaaccctggattgccttcgtagttctggttcaagaaggtgtcaaactgtcccccggtcggtatgga

SEQ ID NO: 1180 - DNA, 200 bp, Conyza canadensis
tccataccgaccgggggacagtttgacaccttcttgaaccagaactacgaaggcaatccagggttgtgcggtccacccatgcaaaacctttgcaacgatgaaaataatcctctatcacccaaaacagacgcttcctcgccacatgaaaaaggcccaaacaagaaactcatcgtcggcctcatcctgggcatctgttttgg

SEQ ID NO: 1181 - DNA, 200 bp, Conyza canadensis
caaactgtcccccggtcggtatggaaccttgtagcttgttgtaagcgacgttgaaagaagacagaaagtacaagcttttgagggaggcagggatctgaccagacagattgttatgggagaggtccagcttttccaagtttgtgagatttgaaatggtagcgggaatggagccagagaaattgtttaggctgagatcaagt

SEQ ID NO: 1182 - DNA, 200 bp, Conyza canadensis
acttgatctcagcctaaacaatttctctggctccattcccgctaccatttcaaatctcacaaacttggaaaagctggacctctcccataacaatctgtctggtcagatccctgcctccctcaaaagcttgtactttctgtcttctttcaacgtcgcttacaacaagctacaaggttccataccgaccgggggacagtttg

SEQ ID NO: 1183 - DNA, 200 bp, Conyza canadensis
gaaattgtttaggctgagatcaagtgtatgaatggactgcatattaccaatctcaacaggtaggctgccaccgagttgattgcttgacaggtacaatgctggaggcagggtggccagctgattgtactgcaagtaggatgcattttgaggggcaacgaatacagggagttccaggtaactgctgtttacacggtccaaaa

SEQ ID NO: 1184 - DNA, 200 bp, Conyza canadensis
ttttggaccgtgtaaacagcagttacctggaactccctgtattcgttgcccctcaaaatgcatcctacttgcagtacaatcagctggccaccctgcctccagcattgtacctgtcaagcaatcaactcggtggcagcctacctgttgagattggtaatatgcagtccattcatacacttgatctcagcctaaacaatttc

SEQ ID NO: 1185 - DNA, 200 bp, Conyza canadensis
taactgctgtttacacggtccaaaacctgctgcgatgcgagggctgggagtctggtaagctccacagggaatcccccggatagagaattattagacaggtccagatagaagaggttcggaagcgtgtgtagccagcccggaatgacgccgtcgatattattctgggagaggtcgatgacctccagattggtaagggaaga

SEQ ID NO: 1186 - DNA, 200 bp, Conyza canadensis
tcttcccttaccaatctggaggtcatcgacctctcccagaataatatcgacggcgtcattccgggctggctacacacgcttccgaacctcttctatctggacctgtctaataattctctatccgggggattccctgtggagcttaccagactcccagccctcgcatcgcagcaggttttggaccgtgtaaacagcagtta

SEQ ID NO: 1187 - DNA, 200 bp, Conyza canadensis
tgacctccagattggtaagggaagagagccacgtggggatctgaccgaacagcttgcagccaccaagacccatgatcttgagattggagaaaccagagatgggttgaggggggaggggttcgttgaagaagttcttggagaggatgagggtggtgagtttcggatgcctgctcaggatattgaatgcgcttgtgatgttc

SEQ ID NO: 1188 - DNA, 200 bp, Conyza canadensis
gaacatcacaagcgcattcaatatcctgagcaggcatccgaaactcaccaccctcatcctctccaagaacttcttcaacgaacccctcccccctcaacccatctctggtttctccaatctcaagatcatgggtcttggtggctgcaagctgttcggtcagatccccacgtggctctcttcccttaccaatctggaggtca

SEQ ID NO: 1189 - DNA, 200 bp, Conyza canadensis
gatattgaatgcgcttgtgatgttcctgagggtgttgtttgaaagggagaggaaggagagagcaggcaggccgaggacatgagcggggatttcccctcgcagcctgttggtggccagccggattgcggtgagcgatttgcaagagaagacggtggccggcagctcccctgcgaatcggttttcgccaaggtcaaggatgg

SEQ ID NO: 1190 - DNA, 200 bp, Conyza canadensis
ccatccttgaccttggcgaaaaccgattcgcaggggagctgccggccaccgtcttctcttgcaaatcgctcaccgcaatccggctggccaccaacaggctgcgaggggaaatccccgctcatgtcctcggcctgcctgctctctccttcctctccctttcaaacaacaccctcaggaacatcacaagcgcattcaatatc

SEQ ID NO: 1191 - DNA, 200 bp, Conyza canadensis
cggttttcgccaaggtcaaggatggtgagcctggtgaaaccggagaaatcaaaatccgagagaatgccggtgaaggagttgaccctgagattgagaagctgcagggatttgcagttgacgagggaaggaggaagggttccattgagacggttgatgtgaagttcaagtttctgcaacaaggggaggttgccaatggcgtg

SEQ ID NO: 1192 - DNA, 200 bp, Conyza canadensis
cacgccattggcaacctccccttgttgcagaaacttgaacttcacatcaaccgtctcaatggaacccttcctccttccctcgtcaactgcaaatccctgcagcttctcaatctcagggtcaactccttcaccggcattctctcggattttgatttctccggtttcaccaggctcaccatccttgaccttggcgaaaaccg

SEQ ID NO: 1193 - DNA, 200 bp, Conyza canadensis
acaaggggaggttgccaatggcgtgggggatgggcccgctaaagttgttgccaaacaaggcaagagtggtgaggttggtgagggtggtgatggaatcgggaatggggccggtgagagagttcccagggaacgatagatggcggagggaaggggtggtggaaacgtggaaaggggcaagggcgccggtgaggttgttaaac

SEQ ID NO: 1194 - DNA, 200 bp, Conyza canadensis
gtttaacaacctcaccggcgcccttgcccctttccacgtttccaccaccccttccctccgccatctatcgttccctgggaactctctcaccggccccattcccgattccatcaccaccctcaccaacctcaccactcttgccttgtttggcaacaactttagcgggcccatcccccacgccattggcaacctccccttgt

SEQ ID NO: 1195 - DNA, 200 bp, Conyza canadensis
aagggcgccggtgaggttgttaaaccccagactcaaaacctggagggaagcacaggggcccgacaaaggggggaaatccccggtgaagtcgttcaaggagagatcgaggatggtcagattagagttgcatatggtggaggtggggacggggcctgtcaaggtgttgttgctgacattgagggcaatcaaagaagggaaag

SEQ ID NO: 1196 - DNA, 200 bp, Conyza canadensis
ctttcccttctttgattgccctcaatgtcagcaacaacaccttgacaggccccgtccccacctccaccatatgcaactctaatctgaccatcctcgatctctccttgaacgacttcaccggggatttcccccctttgtcgggcccctgtgcttccctccaggttttgagtctggggtttaacaacctcaccggcgccctt

SEQ ID NO: 1197 - DNA, 200 bp, Conyza canadensis
ttgagggcaatcaaagaagggaaagaagggaagaaggtaggcggaatcgtgccattcagataattactggacagattcagggtggagatggtggtcgtggtgggttgtggcaggttcccagaaagtctgttgtaacttaagtcaacggtgtggagatggttgaaaaattgtggtgggaggggaccagataggaaattaca

SEQ ID NO: 1198 - DNA, 200 bp, Conyza canadensis
tgtaatttcctatctggtcccctcccaccacaatttttcaaccatctccacaccgttgacttaagttacaacagactttctgggaacctgccacaacccaccacgaccaccatctccaccctgaatctgtccagtaattatctgaatggcacgattccgcctaccttcttcccttctttcccttctttgattgccctcaa

SEQ ID NO: 1199 - DNA, 200 bp, Conyza canadensis
ggaggggaccagataggaaattacaggacaggtttaggaaagatagggatgtcagattttcaagaggggcataataatcattgtaattggtcgtagtaaggcctctatttggtaaggaaatcccgaccacacggtgaccttgatcatcacaactgattccatcccacaaacagcaatcttctccttccccattggcagca

SEQ ID NO: 1200 - DNA, 200 bp, Conyza canadensis
tgctgccaatggggaaggagaagattgctgtttgtgggatggaatcagttgtgatgatcaaggtcaccgtgtggtcgggatttccttaccaaatagaggccttactacgaccaattacaatgattattatgcccctcttgaaaatctgacatccctatctttcctaaacctgtcctgtaatttcctatctggtcccctcc

SEQ ID NO: 1201 - DNA, 200 bp, Conyza canadensis
atcttctccttccccattggcagcagcccagttgacgacgctgggaaagttgttgccaaaaagcaacagagaatccttatcatcagagttacaagctgctgctgctgtcgtccttgtacaagcaggaaacaacaaaactaacactaacactagtatcatcaacaaacccctccccacatgatcatgctcacgattatgat

SEQ ID NO: 1202 - DNA, 200 bp, Conyza canadensis
atcataatcgtgagcatgatcatgtggggaggggtttgttgatgatactagtgttagtgttagttttgttgtttcctgcttgtacaaggacgacagcagcagcagcttgtaactctgatgataaggattctctgttgctttttggcaacaactttcccagcgtcgtcaactgggctgctgccaatggggaaggagaagat

SEQ ID NO: 1203 - DNA, 200 bp, Conyza canadensis
acatgatcatgctcacgattatgattgaatgatgaacaacaacacgggaccaacagcatcatcaacaaccaaaccaaaccacaccacaccacccacccacaaacaaacaaagatatatatatatatatatatattactttttgtttctaaaaagaaagaagaaaattatgaagagaaaaagacgacgataatggtaataa

SEQ ID NO: 1204 - DNA, 200 bp, Conyza canadensis
ttattaccattatcgtcgtctttttctcttcataattttcttctttctttttagaaacaaaaagtaatatatatatatatatatatatctttgtttgtttgtgggtgggtggtgtggtgtggtttggtttggttgttgatgatgctgttggtcccgtgttgttgttcatcattcaatcataatcgtgagcatgatcatgt

SEQ ID NO: 1205 - DNA, 200 bp, Conyza canadensis
aaaaagacgacgataatggtaataatcccatttcaattcaaagaaagaaagaaaaaatacaagtggatgttgacgcagaccattagtaaaaaaaaaaaaaaagagaagggcatcaaatcaaatcaaatcaattgaataaattatataattagaaaaaattacaaatagagagggtgtttctattcatttatccattatta

SEQ ID NO: 1206 - DNA, 200 bp, Conyza canadensis
taataatggataaatgaatagaaacaccctctctatttgtaattttttctaattatataatttattcaattgatttgatttgatttgatgcccttctctttttttttttttttactaatggtctgcgtcaacatccacttgtattttttctttctttctttgaattgaaatgggattattaccattatcgtcgtcttttt

SEQ ID NO: 1207 - DNA, 200 bp, Conyza canadensis
ttaaagatattttcctcccacttttgggataatttggaaggaaggaaactccactccttctcttctttccccttcctttacatataaactcgagaacacaggctaaggttcaagtttcaagtcttacatttgattactagccaaaacattaattagttattgttatgcaaaaaaaaaaaaaaaaaattataaaaattgaa

SEQ ID NO: 1208 - DNA, 200 bp, Conyza canadensis
ttcaatttttataattttttttttttttttttgcataacaataactaattaatgttttggctagtaatcaaatgtaagacttgaaacttgaaccttagcctgtgttctcgagtttatatgtaaaggaaggggaaagaagagaaggagtggagtttccttccttccaaattatcccaaaagtgggaggaaaatatctttaa

SEQ ID NO: 1209 - DNA, 200 bp, Conyza canadensis
aaaaaaaaaaattataaaaattgaattgattgttaatcaatatcattttatgttgagttatttgttttagtattatattaaaagtaaaataatgctacatgaatttttctttttttctttcttaagcattcaatgcgattttaattaaaataaaataaaatagactatcatttgtagctaattatgtaacatatcaacta

SEQ ID NO: 1210 - DNA, 200 bp, Conyza canadensis
tagttgatatgttacataattagctacaaatgatagtctattttattttattttaattaaaatcgcattgaatgcttaagaaagaaaaaaagaaaaattcatgtagcattattttacttttaatataatactaaaacaaataactcaacataaaatgatattgattaacaatcaattcaatttttataattttttttttt

SEQ ID NO: 1211 - DNA, 200 bp, Conyza canadensis
agctaattatgtaacatatcaactatgttttatacaatactagcattatattcgtgcgatgcggcggtggtcgtgacgacgaaagtgtggtggtggaggcgagtgttggtggtgaatgcgacgtcgagtgccgtagataattcatataaaagtaattgatttaaaaggttaatggagatattttagaaaaataaaggatt

SEQ ID NO: 1212 - DNA, 200 bp, Conyza canadensis
aatcctttatttttctaaaatatctccattaaccttttaaatcaattacttttatatgaattatctacggcactcgacgtcgcattcaccaccaacactcgcctccaccaccacactttcgtcgtcacgaccaccgccgcatcgcacgaatataatgctagtattgtataaaacatagttgatatgttacataattagct

SEQ ID NO: 1213 - DNA, 200 bp, Conyza canadensis
agatattttagaaaaataaaggattgatagtgtaatttaattattaatattaagagaatagtgtatgtgaaaatcttttaaaggtttgtaggcttgtagccttgtaggtgaaaatattacataggagggcattttagacatttccccatgtaactttcaacatggagggtattttctttaatatagagtataaataatgg

SEQ ID NO: 1214 - DNA, 200 bp, Conyza canadensis
ccattatttatactctatattaaagaaaataccctccatgttgaaagttacatggggaaatgtctaaaatgccctcctatgtaatattttcacctacaaggctacaagcctacaaacctttaaaagattttcacatacactattctcttaatattaataattaaattacactatcaatcctttatttttctaaaatatct

SEQ ID NO: 1215 - DNA, 200 bp, Conyza canadensis
ctttaatatagagtataaataatggagatatttaaaaaaaataaaggactgatagtgtaatttaattattaatattaagaaaatagtgtatgtgaaaatattttaaagggttgtaggcttgtagccttgtaggtgaaaatattacataggaggacattttagacatttcccccatgtaactttcaacatggggggtattt

SEQ ID NO: 1216 - DNA, 200 bp, Conyza canadensis
aaataccccccatgttgaaagttacatgggggaaatgtctaaaatgtcctcctatgtaatattttcacctacaaggctacaagcctacaaccctttaaaatattttcacatacactattttcttaatattaataattaaattacactatcagtcctttattttttttaaatatctccattatttatactctatattaaag

SEQ ID NO: 1217 - DNA, 200 bp, Conyza canadensis
gtaactttcaacatggggggtattttctttaatatagagtataaatatagataaataatatatattttgtaaattttttaaactaataaattattttaaaataataatttttataaaatatattttatttgataaataataactctaaattacacagatggtacctataatttgtattatattacatgtttcatacctca

SEQ ID NO: 1218 - DNA, 200 bp, Conyza canadensis
tgaggtatgaaacatgtaatataatacaaattataggtaccatctgtgtaatttagagttattatttatcaaataaaatatattttataaaaattattattttaaaataatttattagtttaaaaaatttacaaaatatatattatttatctatatttatactctatattaaagaaaataccccccatgttgaaagttac

SEQ ID NO: 1219 - DNA, 200 bp, Conyza canadensis
attatattacatgtttcatacctcacatgcaagacacgttggctacttaatgatacaactaacgaccgtcagcgtgaggtatcttctaagtgtaaaattataaacatgatataattgacgtaatttaaatctaacaggtatgaaattaataatttcgaccaaaccaaaggtacttaattcactcttaatatactgtatct

SEQ ID NO: 1220 - DNA, 200 bp, Conyza canadensis
agatacagtatattaagagtgaattaagtacctttggtttggtcgaaattattaatttcatacctgttagatttaaattacgtcaattatatcatgtttataattttacacttagaagatacctcacgctgacggtcgttagttgtatcattaagtagccaacgtgtcttgcatgtgaggtatgaaacatgtaatataat

SEQ ID NO: 1221 - DNA, 200 bp, Conyza canadensis
aattcactcttaatatactgtatctaatactactcgtggtagtattatgtagattcctagcaatggacgacaatattccaacaacataagaagccaaaacccacttccttcctttttttttttgttgttgaataatttaatcagtttttaggaacgaacaacctcctccatttccagataaattattattcagccaagca

SEQ ID NO: 1222 - DNA, 200 bp, Conyza canadensis
tgcttggctgaataataatttatctggaaatggaggaggttgttcgttcctaaaaactgattaaattattcaacaacaaaaaaaaaaaggaaggaagtgggttttggcttcttatgttgttggaatattgtcgtccattgctaggaatctacataatactaccacgagtagtattagatacagtatattaagagtgaatt

SEQ ID NO: 1223 - DNA, 200 bp, Conyza canadensis
agataaattattattcagccaagcaaaaaacacaacatcccttgtttcctcttcttcttgttttctttttctttctttttgctaaaaaactcacacacgcagaagaagaagacgaagacaaagtcagagagttgagtttggactgattgattgatttgttattaaggtaaaaataccacttactactccatccatccatc

SEQ ID NO: 1224 - DNA, 200 bp, Conyza canadensis
gatggatggatggagtagtaagtggtatttttaccttaataacaaatcaatcaatcagtccaaactcaactctctgactttgtcttcgtcttcttcttctgcgtgtgtgagttttttagcaaaaagaaagaaaaagaaaacaagaagaagaggaaacaagggatgttgtgttttttgcttggctgaataataatttatct

SEQ ID NO: 1225 - DNA, 200 bp, Conyza canadensis
ccacttactactccatccatccatccatccatagtagactggtagttgtattagtagtagttagctgctgctttggttattaggattaggatgaagaaactagcagattgttaagtattcttcatgtgactttgttatcttcctttgtaaacaatctcccccaaatataatagcatatcgactaagtggtaatatactta

SEQ ID NO: 1226 - DNA, 200 bp, Conyza canadensis
taagtatattaccacttagtcgatatgctattatatttgggggagattgtttacaaaggaagataacaaagtcacatgaagaatacttaacaatctgctagtttcttcatcctaatcctaataaccaaagcagcagctaactactactaatacaactaccagtctactatggatggatggatggatggagtagtaagtgg

SEQ ID NO: 1227 - DNA, 200 bp, Conyza canadensis
tatcgactaagtggtaatatacttattttttttttaagttgatggtgaactattgtatatggcagggctggtgtttgtctgatcatctgcagcgagctgatagtattattattatgtctctttttggaaatgtctctgccattaacctaactggaaactgtctgctatcaatcactagttccagagatgttttgtcattt

SEQ ID NO: 1228 - DNA, 200 bp, Conyza canadensis
aaatgacaaaacatctctggaactagtgattgatagcagacagtttccagttaggttaatggcagagacatttccaaaaagagacataataataatactatcagctcgctgcagatgatcagacaaacaccagccctgccatatacaatagttcaccatcaacttaaaaaaaaaataagtatattaccacttagtcgata

SEQ ID NO: 1229 - DNA, 200 bp, Conyza canadensis
tagttccagagatgttttgtcatttcggcacggtgatactatgggttatcgcttgcaatcccccccttcttttattaccaaaactaacaaaaatgtctcccctttgaaggtacaacctctgccacatgtatttcattatcactcacaaaatcaattctaatgtctttgtttatctgtgctaaacaggtagtttgtgtcga

SEQ ID NO: 1230 - DNA, 200 bp, Conyza canadensis
tcgacacaaactacctgtttagcacagataaacaaagacattagaattgattttgtgagtgataatgaaatacatgtggcagaggttgtaccttcaaaggggagacatttttgttagttttggtaataaaagaagggggggattgcaagcgataacccatagtatcaccgtgccgaaatgacaaaacatctctggaacta

SEQ ID NO: 1231 - DNA, 200 bp, Conyza canadensis
gtgctaaacaggtagtttgtgtcgactatccaagaccagacctcgataacacctctaatttcttggaagctgcttatttgtcttctaccttccgagcttctccacgcccacctaagccattgaaggttgtaattgctggtgcaggtaaaaccttcatacgtcattatattgtcttttaagtcgcttttgtttgagaattt

SEQ ID NO: 1232 - DNA, 200 bp, Conyza canadensis
aaattctcaaacaaaagcgacttaaaagacaatataatgacgtatgaaggttttacctgcaccagcaattacaaccttcaatggcttaggtgggcgtggagaagctcggaaggtagaagacaaataagcagcttccaagaaattagaggtgttatcgaggtctggtcttggatagtcgacacaaactacctgtttagcac

SEQ ID NO: 1233 - DNA, 200 bp, Conyza canadensis
ttaagtcgcttttgtttgagaatttgatactgccacatctgatagataaccaaatgatacttctagtgtatccccaatgatgctttttatgccacatactaacatctgctttaatttgctatcccacttacttttgcaaacttcgcatatgcaggtctcgctggtttatcaactgcaaagtacttggctgatgccggtca

SEQ ID NO: 1234 - DNA, 200 bp, Conyza canadensis
tgaccggcatcagccaagtactttgcagttgataaaccagcgagacctgcatatgcgaagtttgcaaaagtaagtgggatagcaaattaaagcagatgttagtatgtggcataaaaagcatcattggggatacactagaagtatcatttggttatctatcagatgtggcagtatcaaattctcaaacaaaagcgacttaa

SEQ ID NO: 1235 - DNA, 200 bp, Conyza canadensis
caaagtacttggctgatgccggtcacaagccaattttgctagaagcaagagatgttcttggtggaaaggtaaacgatttataagaaattacaataggatcggaagtcctaggatcccccctccctcttaccttcttctatataacagagcaagcttggtaataaaacaaggattttgggtctaattattctcttctttac

SEQ ID NO: 1236 - DNA, 200 bp, Conyza canadensis
gtaaagaagagaataattagacccaaaatccttgttttattaccaagcttgctctgttatatagaagaaggtaagagggaggggggatcctaggacttccgatcctattgtaatttcttataaatcgtttacctttccaccaagaacatctcttgcttctagcaaaattggcttgtgaccggcatcagccaagtactttg

SEQ ID NO: 1237 - DNA, 200 bp, Conyza canadensis
tgggtctaattattctcttctttacttgctttctgttttcgtctctttcactgataaccaaaggcaatatcagttagggttctaggatgggtcgaagcaaattttagggataccaatgcctaaccaagttcgatcaagactagggatatagagggtattcaatcagcttctggtgggattatagctcgcgactttgaagc

SEQ ID NO: 1238 - DNA, 200 bp, Conyza canadensis
gcttcaaagtcgcgagctataatcccaccagaagctgattgaataccctctatatccctagtcttgatcgaacttggttaggcattggtatccctaaaatttgcttcgacccatcctagaaccctaactgatattgcctttggttatcagtgaaagagacgaaaacagaaagcaagtaaagaagagaataattagaccca

SEQ ID NO: 1239 - DNA, 200 bp, Conyza canadensis
ggattatagctcgcgactttgaagctagagttagggttctttaaagcctaacatagttcaaatacggctggggtgttgggggttcctttctgtacgaatttaaagctggacaaggcagcaaaagagttcgacttgtgtggatttttatctaggtttggctggggtttcaaacaaccgaaggtgtgtttggggttcttggg

SEQ ID NO: 1240 - DNA, 200 bp, Conyza canadensis
cccaagaaccccaaacacaccttcggttgtttgaaaccccagccaaacctagataaaaatccacacaagtcgaactcttttgctgccttgtccagctttaaattcgtacagaaaggaacccccaacaccccagccgtatttgaactatgttaggctttaaagaaccctaactctagcttcaaagtcgcgagctataatcc

SEQ ID NO: 1241 - DNA, 200 bp, Conyza canadensis
cgaaggtgtgtttggggttcttgggatagtcgatcaacattggagtgtctttttcctgttttacaagttagaatacgtgaaatgcatcttcgttcattattttgcttttgacctttatgtgatgggtacaagtttaacaacctactgcatgcggtttctctttgtgctcacatttcactttctctcttttctcttttgca

SEQ ID NO: 1242 - DNA, 200 bp, Conyza canadensis
tgcaaaagagaaaagagagaaagtgaaatgtgagcacaaagagaaaccgcatgcagtaggttgttaaacttgtacccatcacataaaggtcaaaagcaaaataatgaacgaagatgcatttcacgtattctaacttgtaaaacaggaaaaagacactccaatgttgatcgactatcccaagaaccccaaacacaccttcg

SEQ ID NO: 1243 - DNA, 200 bp, Conyza canadensis
cactttctctcttttctcttttgcattgttggggtgggatggctgtttttgctagtaacatttatacaaacctggacctaatgttaggtcaatccgggctgggttcacaactggatggaggaataagggtcggagggaaatattgaatggctcctcaaacccaaagtaacccagatccaaacacttccaatctaaacaac

SEQ ID NO: 1244 - DNA, 200 bp, Conyza canadensis
gttgtttagattggaagtgtttggatctgggttactttgggtttgaggagccattcaatatttccctccgacccttattcctccatccagttgtgaacccagcccggattgacctaacattaggtccaggtttgtataaatgttactagcaaaaacagccatcccaccccaacaatgcaaaagagaaaagagagaaagtg

SEQ ID NO: 1245 - DNA, 200 bp, Conyza canadensis
tccaaacacttccaatctaaacaacccagaccccgtggctgctcaatcaacagccatagcatcatctatgaaatcactgcagcaaagaggtagcaatgatcaagacacagtaagccaaacaaaaacagaaatcaagcggcaatttaaatcaatttgaagatgaaggttcatctggtggtaaccaccgtcactacagacct

SEQ ID NO: 1246 - DNA, 200 bp, Conyza canadensis
aggtctgtagtgacggtggttaccaccagatgaaccttcatcttcaaattgatttaaattgccgcttgatttctgtttttgtttggcttactgtgtcttgatcattgctacctctttgctgcagtgatttcatagatgatgctatggctgttgattgagcagccacggggtctgggttgtttagattggaagtgtttgga

SEQ ID NO: 1247 - DNA, 200 bp, Conyza canadensis
tggtaaccaccgtcactacagaccttataataatatcgatttcccaacttttagtattggagaactgtttacaaggctatgagtattgctatcgagtttgaatccaaggttcacatgaaatttaggaaaagtttttcgtcttcagccaaaacagaatcagtaccttcgaaaccaatagaaacttccaacctgttgccctc

SEQ ID NO: 1248 - DNA, 200 bp, Conyza canadensis
gagggcaacaggttggaagtttctattggtttcgaaggtactgattctgttttggctgaagacgaaaaacttttcctaaatttcatgtgaaccttggattcaaactcgatagcaatactcatagccttgtaaacagttctccaatactaaaagttgggaaatcgatattattataaggtctgtagtgacggtggttacca

SEQ ID NO: 1249 - DNA, 200 bp, Conyza canadensis
tagaaacttccaacctgttgccctcgattgctgctgcccagaaaccaactgaagcccgtctttttgatgttaaaaaatagggcagattcatacgagaagttgtgtctaagtttctgatctactcaaaatttctatcaatttgccttgggggaaagccgatgtggtactcggtattcaataattaggaacacttacaaagt

SEQ ID NO: 1250 - DNA, 200 bp, Conyza canadensis
actttgtaagtgttcctaattattgaataccgagtaccacatcggctttcccccaaggcaaattgatagaaattttgagtagatcagaaacttagacacaacttctcgtatgaatctgccctattttttaacatcaaaaagacgggcttcagttggtttctgggcagcagcaatcgagggcaacaggttggaagtttcta

SEQ ID NO: 1251 - DNA, 200 bp, Conyza canadensis
caataattaggaacacttacaaagtttaggcaaaatggaaggagatagtcatgaagttcactatggatgttaaggagtacaagctacatggacttccaccagatcgtcaaccatcagcaacatttagcgacctcactactgaaccattcgagttacaggcaagtggactagcagctcattttttcacaactggctagtgg

SEQ ID NO: 1252 - DNA, 200 bp, Conyza canadensis
ccactagccagttgtgaaaaaatgagctgctagtccacttgcctgtaactcgaatggttcagtagtgaggtcgctaaatgttgctgatggttgacgatctggtggaagtccatgtagcttgtactccttaacatccatagtgaacttcatgactatctccttccattttgcctaaactttgtaagtgttcctaattattg

SEQ ID NO: 1253 - DNA, 200 bp, Conyza canadensis
tcattttttcacaactggctagtggacaagtcagattttggggccggatgtattgatacaaacctggacccaatgttgggtcaaaccaggtcgggtcagcagctggatggagggaaaaggggtggagggaaatcaagtagtgaaggaattcaagttaggaagtggaccatgcgcccactacatataattgctccactaat

SEQ ID NO: 1254 - DNA, 200 bp, Conyza canadensis
attagtggagcaattatatgtagtgggcgcatggtccacttcctaacttgaattccttcactacttgatttccctccaccccttttccctccatccagctgctgacccgacctggtttgacccaacattgggtccaggtttgtatcaatacatccggccccaaaatctgacttgtccactagccagttgtgaaaaaatga

SEQ ID NO: 1255 - DNA, 200 bp, Conyza canadensis
cactacatataattgctccactaattttagtattatatatgtgtgtttttctgttttttaagctggtcaagatactaagtttgtgattgttcttgtattcggagatttgccatctgaattttgctaatattgtgttagactcagtaatctaaattagtagatttccagtttctatcaaatgttcgtttggtgaaaatgaa

SEQ ID NO: 1256 - DNA, 200 bp, Conyza canadensis
ttcattttcaccaaacgaacatttgatagaaactggaaatctactaatttagattactgagtctaacacaatattagcaaaattcagatggcaaatctccgaatacaagaacaatcacaaacttagtatcttgaccagcttaaaaaacagaaaaacacacatatataatactaaaattagtggagcaattatatgtagtg

SEQ ID NO: 1257 - DNA, 200 bp, Conyza canadensis
caaatgttcgtttggtgaaaatgaataattgaagttcatatgacgaccttatttgagcaggatctgttctataggctcgtacctctgtatccttgattcctatcaagacagaaaagtagtttcatatgaaatttctatttttaaacttttgtatatcataagtagtcaagcttagcttaatttcaaatctaggttgtctt

SEQ ID NO: 1258 - DNA, 200 bp, Conyza canadensis
aagacaacctagatttgaaattaagctaagcttgactacttatgatatacaaaagtttaaaaatagaaatttcatatgaaactacttttctgtcttgataggaatcaaggatacagaggtacgagcctatagaacagatcctgctcaaataaggtcgtcatatgaacttcaattattcattttcaccaaacgaacatttg

SEQ ID NO: 1259 - DNA, 200 bp, Conyza canadensis
cttaatttcaaatctaggttgtcttagtatgttgttacttatcgtgagtgtttttatccacattgctcttctcacataggtagctgcctggaaagatgatgatggagattggtacgagactggtttacacatattttgtaagttttaacttcttatatcctttcaagtgtcgaaaaagagagctgatgtgtgcataaaaa

SEQ ID NO: 1260 - DNA, 200 bp, Conyza canadensis
tttttatgcacacatcagctctctttttcgacacttgaaaggatataagaagttaaaacttacaaaatatgtgtaaaccagtctcgtaccaatctccatcatcatctttccaggcagctacctatgtgagaagagcaatgtggataaaaacactcacgataagtaacaacatactaagacaacctagatttgaaattaag

SEQ ID NO: 1261 - DNA, 200 bp, Conyza canadensis
aagagagctgatgtgtgcataaaaagttattcccataatataattctcaacagggttgttgtcgtctttttgtgcactatctatctgctctaagttattgtttctccacgtacctttccttttggacatttgtcactagacacctaatgtgcaataaacttcttcatttgcttgaagttggagcttacccgaatatacag

SEQ ID NO: 1262 - DNA, 200 bp, Conyza canadensis
ctgtatattcgggtaagctccaacttcaagcaaatgaagaagtttattgcacattaggtgtctagtgacaaatgtccaaaaggaaaggtacgtggagaaacaataacttagagcagatagatagtgcacaaaaagacgacaacaaccctgttgagaattatattatgggaataactttttatgcacacatcagctctctt

SEQ ID NO: 1263 - DNA, 200 bp, Conyza canadensis
agttggagcttacccgaatatacagaatctgtttggagagttaggcattagtgatagattgcagtggaaggagcattcaatgatatttgcgatgccaaacaaacctggagaatttagtcggtttgatttcccagatgttctgccggcaccattgaatggtaagtatgctattattagcctattttttttggtgtatatat

SEQ ID NO: 1264 - DNA, 200 bp, Conyza canadensis
atatatacaccaaaaaaaataggctaataatagcatacttaccattcaatggtgccggcagaacatctgggaaatcaaaccgactaaattctccaggtttgtttggcatcgcaaatatcattgaatgctccttccactgcaatctatcactaatgcctaactctccaaacagattctgtatattcgggtaagctccaact

SEQ ID NO: 1265 - DNA, 200 bp, Conyza canadensis
agcctattttttttggtgtatatattttatttaaatgatttggtggtgagcattttctgcatcaccaacatgacaaaaaagatctaaaacaagatcagtcagggaatgctagattactaacaaatgtgactctgcataccatctcaggaatttgggctatcttgaggaacaatgaaatgctgacatggcctgagaaagta

SEQ ID NO: 1266 - DNA, 200 bp, Conyza canadensis
tactttctcaggccatgtcagcatttcattgttcctcaagatagcccaaattcctgagatggtatgcagagtcacatttgttagtaatctagcattccctgactgatcttgttttagatcttttttgtcatgttggtgatgcagaaaatgctcaccaccaaatcatttaaataaaatatatacaccaaaaaaaataggct

SEQ ID NO: 1267 - DNA, 200 bp, Conyza canadensis
aatgctgacatggcctgagaaagtaaaatttgctatcgggctcttgcctgcaatgttaggtggacaggcttatgttgaggcacaagatggtctgagtgttcaagactggatgagacaacgggtatgtagtcgtttatgtaaatatttcttttaccattttttagtttaatacataagaaacaatggccatgatacctggt

SEQ ID NO: 1268 - DNA, 200 bp, Conyza canadensis
accaggtatcatggccattgtttcttatgtattaaactaaaaaatggtaaaagaaatatttacataaacgactacatacccgttgtctcatccagtcttgaacactcagaccatcttgtgcctcaacataagcctgtccacctaacattgcaggcaagagcccgatagcaaattttactttctcaggccatgtcagcatt

SEQ ID NO: 1269 - DNA, 200 bp, Conyza canadensis
agaaacaatggccatgatacctggtatatttgataatggtaacgtttctaagtggaagatccagaggtcaaaccttagcaggggctttttttaggaagattgttggctaattaaaccccctgcttaataattcgagttcttgtttcttttgttatgaattttatttaataattaatgcacatttttcatttttccagggc

SEQ ID NO: 1270 - DNA, 200 bp, Conyza canadensis
gccctggaaaaatgaaaaatgtgcattaattattaaataaaattcataacaaaagaaacaagaactcgaattattaagcagggggtttaattagccaacaatcttcctaaaaaaagcccctgctaaggtttgacctctggatcttccacttagaaacgttaccattatcaaatataccaggtatcatggccattgtttct

SEQ ID NO: 1271 - DNA, 200 bp, Conyza canadensis
tgcacatttttcatttttccagggcataccagatcgagttactacagaggtgtttattgccatgtcaaaggcattaaacttcatcaatccagatgaactttcaatgcaatgtattctgattgctctgaaccgatttcttcaggtgaaggcatcattctcttagagcttactggttaaataatgatgaaaaattaatctca

SEQ ID NO: 1272 - DNA, 200 bp, Conyza canadensis
tgagattaatttttcatcattatttaaccagtaagctctaagagaatgatgccttcacctgaagaaatcggttcagagcaatcagaatacattgcattgaaagttcatctggattgatgaagtttaatgcctttgacatggcaataaacacctctgtagtaactcgatctggtatgccctggaaaaatgaaaaatgtgca

SEQ ID NO: 1273 - DNA, 200 bp, Conyza canadensis
aaataatgatgaaaaattaatctcatgacttttaattccatcttccgtctgtcatatatgataagttggtcacggactcaagtcactaatatattatatggattgattttacgcttgtgattggtcaagtagacaaagcatgcaaagttatatgggtttagtgtaattagtgtctgttgcattgctcactgtatgtctgt

SEQ ID NO: 1274 - DNA, 200 bp, Conyza canadensis
acagacatacagtgagcaatgcaacagacactaattacactaaacccatataactttgcatgctttgtctacttgaccaatcacaagcgtaaaatcaatccatataatatattagtgacttgagtccgtgaccaacttatcatatatgacagacggaagatggaattaaaagtcatgagattaatttttcatcattattt

SEQ ID NO: 1275 - DNA, 200 bp, Conyza canadensis
gttgcattgctcactgtatgtctgtattggttgctataagccagcgtgctaccttgaaagcaactctatttccttttccatgatcaagtattattacatatatattgtgcttctagaatccagatacagagatttgggttatttttgtggttttgaaataggagggcggcctctatagttaatctcgaagtgcttattgt

SEQ ID NO: 1276 - DNA, 200 bp, Conyza canadensis
acaataagcacttcgagattaactatagaggccgccctcctatttcaaaaccacaaaaataacccaaatctctgtatctggattctagaagcacaatatatatgtaataatacttgatcatggaaaaggaaatagagttgctttcaaggtagcacgctggcttatagcaaccaatacagacatacagtgagcaatgcaac

SEQ ID NO: 1277 - DNA, 200 bp, Conyza canadensis
tagttaatctcgaagtgcttattgtacaccatggatttttgaaacaaagagttgatcgctcttatctgtagcttcttaacacttcaatattggcttggttgcaatactacatggcatagacattggacaccatagataatacaacttgtaaattgtttgtaataaatcaacaggagaagcatggttctaagatggcattt

SEQ ID NO: 1278 - DNA, 200 bp, Conyza canadensis
aaatgccatcttagaaccatgcttctcctgttgatttattacaaacaatttacaagttgtattatctatggtgtccaatgtctatgccatgtagtattgcaaccaagccaatattgaagtgttaagaagctacagataagagcgatcaactctttgtttcaaaaatccatggtgtacaataagcacttcgagattaacta

SEQ ID NO: 1279 - DNA, 200 bp, Conyza canadensis
gaagcatggttctaagatggcatttttagatggcagcccacctgaaagactttgcatgccaattgttgagcatattgagtcactaggtggccaagtcaggcttaattcgcgaatacaaaagatcgagttgaacaaagatggaacagttaggaactttttactttatgatggaaatattattgaaggtgatgcttatgtat

SEQ ID NO: 1280 - DNA, 200 bp, Conyza canadensis
atacataagcatcaccttcaataatatttccatcataaagtaaaaagttcctaactgttccatctttgttcaactcgatcttttgtattcgcgaattaagcctgacttggccacctagtgactcaatatgctcaacaattggcatgcaaagtctttcaggtgggctgccatctaaaaatgccatcttagaaccatgcttc

SEQ ID NO: 1281 - DNA, 200 bp, Conyza canadensis
attattgaaggtgatgcttatgtatttgctactccaggtacatttagagaacgactatttgaatctgtagctttcacatgtctgttggggttgtagctttattgattattttgtgtcaaacagttgatattctgaagcttctgttgcctgaagattggaaagcaattccttacttcaagaagttggataaattagttggt

SEQ ID NO: 1282 - DNA, 200 bp, Conyza canadensis
accaactaatttatccaacttcttgaagtaaggaattgctttccaatcttcaggcaacagaagcttcagaatatcaactgtttgacacaaaataatcaataaagctacaaccccaacagacatgtgaaagctacagattcaaatagtcgttctctaaatgtacctggagtagcaaatacataagcatcaccttcaataat

SEQ ID NO: 1283 - DNA, 200 bp, Conyza canadensis
caagaagttggataaattagttggtgtcccagttataaacgttcatatatggttagttggatccttcaatataattctaaacatggcacagtaatcattcaccttaatttaatagagtctggcttctgtcttgaccattaatctgacttagtaaaacccctatatgtattctttgtaattgttaaacaccactttcaggt

SEQ ID NO: 1284 - DNA, 200 bp, Conyza canadensis
acctgaaagtggtgtttaacaattacaaagaatacatataggggttttactaagtcagattaatggtcaagacagaagccagactctattaaattaaggtgaatgattactgtgccatgtttagaattatattgaaggatccaactaaccatatatgaacgtttataactgggacaccaactaatttatccaacttcttg

SEQ ID NO: 1285 - DNA, 200 bp, Conyza canadensis
taattgttaaacaccactttcaggtttgacaggaaactcaaaaacacctatgatcacctactcttcagcaggtcacctctcaactcttattcttgcaacactattacttaatttttagtagacaaggctgttgagctttttatttgtatgttattcatgccactgctacctaaacggatcttttacttccatttcaaatg

SEQ ID NO: 1286 - DNA, 200 bp, Conyza canadensis
catttgaaatggaagtaaaagatccgtttaggtagcagtggcatgaataacatacaaataaaaagctcaacagccttgtctactaaaaattaagtaatagtgttgcaagaataagagttgagaggtgacctgctgaagagtaggtgatcataggtgtttttgagtttcctgtcaaacctgaaagtggtgtttaacaatta

SEQ ID NO: 1287 - DNA, 200 bp, Conyza canadensis
ggatcttttacttccatttcaaatgtctggggcgtgtcgtccataaaggttctctacagttcatagagtaacttagagtaagcttacaccccacctattaactaaacaaagcaacacaagttaggctatatggtacatgctaaagtgatggtcaagattgcaccatttgctaccgccttgagataccagtgtcccagctt

SEQ ID NO: 1288 - DNA, 200 bp, Conyza canadensis
aagctgggacactggtatctcaaggcggtagcaaatggtgcaatcttgaccatcactttagcatgtaccatatagcctaacttgtgttgctttgtttagttaataggtggggtgtaagcttactctaagttactctatgaactgtagagaacctttatggacgacacgccccagacatttgaaatggaagtaaaagatcc

SEQ ID NO: 1289 - DNA, 200 bp, Conyza canadensis
ccttgagataccagtgtcccagcttctgcttacacttcatagtttatactcaaatttaatattggtacaaaaaagagtactgaacctatcagtttagtcttttgtattaattatttagtttgcatgcaggagccctcttctcagtgtatatgccgacatgtctgtaacatgcaaggtaaagacaagacaaacatatatga

SEQ ID NO: 1290 - DNA, 200 bp, Conyza canadensis
tcatatatgtttgtcttgtctttaccttgcatgttacagacatgtcggcatatacactgagaagagggctcctgcatgcaaactaaataattaatacaaaagactaaactgataggttcagtactcttttttgtaccaatattaaatttgagtataaactatgaagtgtaagcagaagctgggacactggtatctcaagg

SEQ ID NO: 1291 - DNA, 200 bp, Conyza canadensis
gtaaagacaagacaaacatatatgaaacaaaccattttcttccagacaaacctgctttgctgttttcatatggttccttgtcatgcaaacaatgaggagatggatgtctattggcctctcctctcattcctattttcccggaaaatgggttaaatctgtctttgtaattttatctttgtcgcatgcatgggacataactt

SEQ ID NO: 1292 - DNA, 200 bp, Conyza canadensis
aagttatgtcccatgcatgcgacaaagataaaattacaaagacagatttaacccattttccgggaaaataggaatgagaggagaggccaatagacatccatctcctcattgtttgcatgacaaggaaccatatgaaaacagcaaagcaggtttgtctggaagaaaatggtttgtttcatatatgtttgtcttgtctttac

SEQ ID NO: 1293 - DNA, 200 bp, Conyza canadensis
ttgtcgcatgcatgggacataacttctcacaatgcacataactcaaatatttaccaaaacctcccgcatttttaaaaccaggctatatataagttgtaaattacatgatgtgaacccatacctcccatcaaggttgttctgataatagtgctcccattttatacaggaatactatgatcctaaccggtccatgttagagt

SEQ ID NO: 1294 - DNA, 200 bp, Conyza canadensis
actctaacatggaccggttaggatcatagtattcctgtataaaatgggagcactattatcagaacaaccttgatgggaggtatgggttcacatcatgtaatttacaacttatatatagcctggttttaaaaatgcgggaggttttggtaaatatttgagttatgtgcattgtgagaagttatgtcccatgcatgcgacaa

SEQ ID NO: 1295 - DNA, 200 bp, Conyza canadensis
gatcctaaccggtccatgttagagttggtttttgcacctgcagaagaatggatttcacgcagtgactctgatattattgacgctacgatgagtgaactttcaagactatttccggatgaaattgcagcagatcagagcaaagcaaaaatattgaaataccatgtagttaaaaccccaaggttagaaatatcttaccagta

SEQ ID NO: 1296 - DNA, 200 bp, Conyza canadensis
tactggtaagatatttctaaccttggggttttaactacatggtatttcaatatttttgctttgctctgatctgctgcaatttcatccggaaatagtcttgaaagttcactcatcgtagcgtcaataatatcagagtcactgcgtgaaatccattcttctgcaggtgcaaaaaccaactctaacatggaccggttaggatc

SEQ ID NO: 1297 - DNA, 200 bp, Conyza canadensis
caaggttagaaatatcttaccagtaaggggttttcaacgattcggtttacgagctcttcgctttggtttccttgatttgacaatccttgaagctcaaaccaaaaaccaaatcaaaccgaattaatcagaaacaagccaaaccaaataagatggtttggttttggttcgaatgcgattgaaaccaaaccattttcaaataa

SEQ ID NO: 1298 - DNA, 200 bp, Conyza canadensis
ttatttgaaaatggtttggtttcaatcgcattcgaaccaaaaccaaaccatcttatttggtttggcttgtttctgattaattcggtttgatttggtttttggtttgagcttcaaggattgtcaaatcaaggaaaccaaagcgaagagctcgtaaaccgaatcgttgaaaaccccttactggtaagatatttctaaccttg

SEQ ID NO: 1299 - DNA, 200 bp, Conyza canadensis
ttgaaaccaaaccattttcaaataatgcagattttatgctggcaaatgttatctaaactttttggcaaatgaaaatttgctgagattcatttaccaccaaaaacttactatatgaaaagaaatatataatgtattataaacttacattataagttattttaaattaatttgataggaaatatatatatatatatatacac

SEQ ID NO: 1300 - DNA, 200 bp, Conyza canadensis
gtgtatatatatatatatatatttcctatcaaattaatttaaaataacttataatgtaagtttataatacattatatatttcttttcatatagtaagtttttggtggtaaatgaatctcagcaaattttcatttgccaaaaagtttagataacatttgccagcataaaatctgcattatttgaaaatggtttggtttcaa

SEQ ID NO: 1301 - DNA, 200 bp, Conyza canadensis
ttattattattattatattattactacttgctactattctattttaattacattattattattaattatgtatgatataatgagagagttgaagaacaactagatattaatcaaatccatccatccatccatcatgacgacgaccaatagagagagagagagagcgcgcgtttactttgtttattttatatgagtagtaa

SEQ ID NO: 1302 - DNA, 200 bp, Conyza canadensis
ttactactcatataaaataaacaaagtaaacgcgcgctctctctctctctctattggtcgtcgtcatgatggatggatggatggatttgattaatatctagttgttcttcaactctctcattatatcatacataattaataataataatgtaattaaaatagaatagtagcaagtagtaataatataataataataataa

SEQ ID NO: 1303 - DNA, 200 bp, Conyza canadensis
tttgtttattttatatgagtagtaagtatttgatgtttttattttaatcaaggaaattactgtaattaaattcaattgacttgaattggtggaaggagggagggtgggggcggctgttcgctcatcagtcatcaccatccatctctcatcgtgtcatgatgtatatatatatattatatatatatagagagagagaggga

SEQ ID NO: 1304 - DNA, 200 bp, Conyza canadensis
tccctctctctctctatatatatataatatatatatatacatcatgacacgatgagagatggatggtgatgactgatgagcgaacagccgcccccaccctccctccttccaccaattcaagtcaattgaatttaattacagtaatttccttgattaaaataaaaacatcaaatacttactactcatataaaataaacaaa

SEQ ID NO: 1305 - DNA, 200 bp, Conyza canadensis
atatatatatagagagagagagggagattaataaaatacaaatggacaaatgcaaatgggaattattattattattattatttatttagctttatatggatatggaaatggatggtgtgggcatctcatcaaatcaaatagaatccaaccattacaagtgcgcctttttccttttctttctaaagtggagagacggattg

SEQ ID NO: 1306 - DNA, 200 bp, Conyza canadensis
caatccgtctctccactttagaaagaaaaggaaaaaggcgcacttgtaatggttggattctatttgatttgatgagatgcccacaccatccatttccatatccatataaagctaaataaataataataataataataattcccatttgcatttgtccatttgtattttattaatctccctctctctctctatatatatat

SEQ ID NO: 1307 - DNA, 33 bp, Conyza canadensis; identical to SEQ ID NO: 45

SEQ ID NO: 1308 - DNA, 33 bp, Conyza canadensis
tttcccttcttttctcttcttctctcaaataaa

SEQ ID NO: 1309 - DNA, 200 bp, Digitaria sanguinalis
aaagaagccaaaaacaatctcaacccaacaacatcttcttcttcttctaataataagtacctgcaaggtcatgtctctacttggaaattctatagtaaccacccatgtactgtcctttagtcacgctgatattatgggtgctcatcggttgcaattcccggctgtccgatcaagaaccaccactaccaagaatgtctgcc

SEQ ID NO: 1310 - DNA, 200 bp, Digitaria sanguinalis
ggcagacattcttggtagtggtggttcttgatcggacagccgggaattgcaaccgatgagcacccataatatcagcgtgactaaaggacagtacatgggtggttactatagaatttccaagtagagacatgaccttgcaggtacttattattagaagaagaagaagatgttgttgggttgagattgtttttggcttcttt

SEQ ID NO: 1311 - DNA, 200 bp, Digitaria sanguinalis
accaccactaccaagaatgtctgccctttcaaggtgctctgcctggattatccaagaccagaccttgacaacacttctaacttcctggaagctgcctacttgtcttctaccttccgcacttcccctcctccagctaaacccttaaacgttgtaattgctggtgcaggtttggctggtctatccactgctaagtatttggc

SEQ ID NO: 1312 - DNA, 200 bp, Digitaria sanguinalis
gccaaatacttagcagtggatagaccagccaaacctgcaccagcaattacaacgtttaagggtttagctggaggaggggaagtgcggaaggtagaagacaagtaggcagcttccaggaagttagaagtgttgtcaaggtctggtcttggataatccaggcagagcaccttgaaagggcagacattcttggtagtggtggt

SEQ ID NO: 1313 - DNA, 200 bp, Digitaria sanguinalis
caatgactttcacatgtgccctatacataaaaggtcctacggctcacatgattaagaaggaattcattattaagtggaaatataaatatctttcgcattaaaaattttgatatctgtgctagatgtattgaagtgtgggactttgtcattgcgaacatgtcagtagtcactgtgttgtattgaagaatcatgatatatta

SEQ ID NO: 1314 - DNA, 200 bp, Digitaria sanguinalis
taatatatcatgattcttcaatacaacacagtgactactgacatgttcgcaatgacaaagtcccacacttcaatacatctagcacagatatcaaaatttttaatgcgaaagatatttatatttccacttaataatgaattccttcttaatcatgtgagccgtaggaccttttatgtatagggcacatgtgaaagtcattg

SEQ ID NO: 1315 - DNA, 200 bp, Digitaria sanguinalis
tgtattgaagaatcatgatatattaggtagcgatggaaatatgcacactcaccttttttctttccttttgttgtgtaaccctctacaggaatactatgatccaaaccgttcaatgctggagttggtctttgctcctgcagaggaatggattggacgaagtgaaactgaaattattgatgcaactatggaagagctagcca

SEQ ID NO: 1316 - DNA, 200 bp, Digitaria sanguinalis
tggctagctcttccatagttgcatcaataatttcagtttcacttcgtccaatccattcctctgcaggagcaaagaccaactccagcattgaacggtttggatcatagtattcctgtagagggttacacaacaaaaggaaagaaaaaaggtgagtgtgcatatttccatcgctacctaatatatcatgattcttcaataca

SEQ ID NO: 1317 - DNA, 200 bp, Digitaria sanguinalis
gatgcaactatggaagagctagccaagttatttcctgatgaaattgctgccgatcagagtaaagcaaagatcattaagtatcatgttgtgaagacaccgaggtgaggttatttgtcagacactcctgatagataagcataagtagctctagctctgatagttttagtttagtgtttttttttgtgtgtgtgtgtgtgtgt

SEQ ID NO: 1318 - DNA, 200 bp, Digitaria sanguinalis
acacacacacacacacacaaaaaaaaacactaaactaaaactatcagagctagagctacttatgcttatctatcaggagtgtctgacaaataacctcacctcggtgtcttcacaacatgatacttaatgatctttgctttactctgatcggcagcaatttcatcaggaaataacttggctagctcttccatagttgcatc

SEQ ID NO: 1319 - DNA, 200 bp, Digitaria sanguinalis
tttttttgtgtgtgtgtgtgtgtgtgttgtttccttatgttcatactctgccttgctttgacagatcggtttacaaaactgttccaaactgtgaaccttgccgacctctccaaaggtcaccgattgaagggttctatttggctggtgattacacaaagcagaaatacttggcctccatggaaggtgcagtactatctggg

SEQ ID NO: 1320 - DNA, 200 bp, Digitaria sanguinalis
cccagatagtactgcaccttccatggaggccaagtatttctgctttgtgtaatcaccagccaaatagaacccttcaatcggtgacctttggagaggtcggcaaggttcacagtttggaacagttttgtaaaccgatctgtcaaagcaaggcagagtatgaacataaggaaacaacacacacacacacacacacaaaaaaa

SEQ ID NO: 1321 - DNA, 200 bp, Digitaria sanguinalis
catggaaggtgcagtactatctgggaagctttgcgcccaatctatagtgcaggtaaacactcgccacatgttcttggttgtacataaaagcatcagattgcttgtaagtttgatcattttgatgtggtacattttggcagctaatgatttaacatctgctgctttcaggattatagcaggctctccctcaggagccagaa

SEQ ID NO: 1322 - DNA, 200 bp, Digitaria sanguinalis
ttctggctcctgagggagagcctgctataatcctgaaagcagcagatgttaaatcattagctgccaaaatgtaccacatcaaaatgatcaaacttacaagcaatctgatgcttttatgtacaaccaagaacatgtggcgagtgtttacctgcactatagattgggcgcaaagcttcccagatagtactgcaccttccatg

SEQ ID NO: 1323 - DNA, 200 bp, Digitaria sanguinalis
gtctgaaagatacttgcgtgattgtttgcaatactctggtccttttcatcgtttgctccttttataattagttttttcgtttatgcactgaacagatagctgcttggaaggatgaagatggagattggtatgagaccgggcttcatatcttttgtaagttacagtttctggtccttgaggttctcttaatgatatttgat

SEQ ID NO: 1324 - DNA, 200 bp, Digitaria sanguinalis
atcaaatatcattaagagaacctcaaggaccagaaactgtaacttacaaaagatatgaagcccggtctcataccaatctccatcttcatccttccaagcagctatctgttcagtgcataaacgaaaaaactaattataaaaggagcaaacgatgaaaaggaccagagtattgcaaacaatcacgcaagtatctttcagac

SEQ ID NO: 1325 - DNA, 200 bp, Digitaria sanguinalis
tgaggttctcttaatgatatttgattttctagattatctctattagaaacatgcatttaacgaagacatgttaacaaactgttgaggcataccagcacacaaacttctaaaccacagttgtgtctatcgtgcttgtttatttttttttatggaatatctgttttattttgcaaaatcatgattgagagaggagttttgtt

SEQ ID NO: 1326 - DNA, 200 bp, Digitaria sanguinalis
aacaaaactcctctctcaatcatgattttgcaaaataaaacagatattccataaaaaaaaataaacaagcacgatagacacaactgtggtttagaagtttgtgtgctggtatgcctcaacagtttgttaacatgtcttcgttaaatgcatgtttctaatagagataatctagaaaatcaaatatcattaagagaacctca

SEQ ID NO: 1327 - DNA, 200 bp, Digitaria sanguinalis
tcatgattgagagaggagttttgttaaattacttagtgtcaaaatagcctgaaaagtttgcaggctactaaagcatacatcatttcatgtttcaatcatgttgtatactccatagtatccataatggcatagctgaatatatgttattctgttcacaagagcattcgattgctaccatccctttatgtaacaatgcattt

SEQ ID NO: 1328 - DNA, 200 bp, Digitaria sanguinalis
aaatgcattgttacataaagggatggtagcaatcgaatgctcttgtgaacagaataacatatattcagctatgccattatggatactatggagtatacaacatgattgaaacatgaaatgatgtatgctttagtagcctgcaaacttttcaggctattttgacactaagtaatttaacaaaactcctctctcaatcatga

SEQ ID NO: 1329 - DNA, 200 bp, Digitaria sanguinalis
catccctttatgtaacaatgcattttttgttttaagttggagcttatcccaacatacagaatttgtttggcgagcttggtattgaggaccgtttgcaatggaaagaacattctatgatatttgccatgccgaacaagccaggagaattcagccggtttgatttcccagaaactttgcccgcacctgtaaatggtatgatt

SEQ ID NO: 1330 - DNA, 200 bp, Digitaria sanguinalis
aatcataccatttacaggtgcgggcaaagtttctgggaaatcaaaccggctgaattctcctggcttgttcggcatggcaaatatcatagaatgttctttccattgcaaacggtcctcaataccaagctcgccaaacaaattctgtatgttgggataagctccaacttaaaacaaaaaatgcattgttacataaagggatg

SEQ ID NO: 1331 - DNA, 200 bp, Digitaria sanguinalis
gcccgcacctgtaaatggtatgattatacacgatgttgaagtcgttgcaacagatttcatagagaatccagaaatgcattgcttcaggctggggctgtgtccctaaaactctaaaagaaaatgcagaaatgcattctaatcttagtccactcatttttttctaatatatgacagcattagagggtttattagtggcagta

SEQ ID NO: 1332 - DNA, 200 bp, Digitaria sanguinalis
tactgccactaataaaccctctaatgctgtcatatattagaaaaaaatgagtggactaagattagaatgcatttctgcattttcttttagagttttagggacacagccccagcctgaagcaatgcatttctggattctctatgaaatctgttgcaacgacttcaacatcgtgtataatcataccatttacaggtgcgggc

SEQ ID NO: 1333 - DNA, 200 bp, Digitaria sanguinalis
attagagggtttattagtggcagtagtaacactacatgattaccattcagcttacacttccaattcatgttgtacttatgatttaccattgtacttttaacaggaatttgggccatactgagaaataatgaaatgcttacctggccagagaaggtgaagtttgctattgggcttcttccagcaatggttggtggtcaacc

SEQ ID NO: 1334 - DNA, 200 bp, Digitaria sanguinalis
ggttgaccaccaaccattgctggaagaagcccaatagcaaacttcaccttctctggccaggtaagcatttcattatttctcagtatggcccaaattcctgttaaaagtacaatggtaaatcataagtacaacatgaattggaagtgtaagctgaatggtaatcatgtagtgttactactgccactaataaaccctctaat

SEQ ID NO: 1335 - DNA, 200 bp, Digitaria sanguinalis
ttccagcaatggttggtggtcaaccttatgttgaagctcaagatggctttacggtttcagaatggatgaaaaaacaggtacgagttcaatttgttggttagacttatctccatgtacaagaaatactgccatctcatcaatactagagagcctttagtttgccaaaagattgtttccttggcttttcttatcttcctgaa

SEQ ID NO: 1336 - DNA, 200 bp, Digitaria sanguinalis
ttcaggaagataagaaaagccaaggaaacaatcttttggcaaactaaaggctctctagtattgatgagatggcagtatttcttgtacatggagataagtctaaccaacaaattgaactcgtacctgttttttcatccattctgaaaccgtaaagccatcttgagcttcaacataaggttgaccaccaaccattgctggaa

SEQ ID NO: 1337 - DNA, 200 bp, Digitaria sanguinalis
ccttggcttttcttatcttcctgaagtacaggtagatgaaaatgcttcatatgctcaaattcttatcttacatttggtgtaaatctctttctgcaaaaatttagacaaggctgctcatagacttgttaactttgccagttaaagtccagcaatgttcatctgtaaattcagcactgtaacaaaaaatggggaaaaaaagg

SEQ ID NO: 1338 - DNA, 200 bp, Digitaria sanguinalis
cctttttttccccattttttgttacagtgctgaatttacagatgaacattgctggactttaactggcaaagttaacaagtctatgagcagccttgtctaaatttttgcagaaagagatttacaccaaatgtaagataagaatttgagcatatgaagcattttcatctacctgtacttcaggaagataagaaaagccaagg

SEQ ID NO: 1339 - DNA, 200 bp, Digitaria sanguinalis
gtaacaaaaaatggggaaaaaaaggacgagcacataagagtttcttgctaactgatgtacataagcagcgttcttcaaattttggtttcacctttgtaatttggaatacagatggtaatatatctttctatttttttatggagccatttggtgcctgatacaattatttgatcagcacagggtgttcctgatcgagtgaa

SEQ ID NO: 1340 - DNA, 200 bp, Digitaria sanguinalis
ttcactcgatcaggaacaccctgtgctgatcaaataattgtatcaggcaccaaatggctccataaaaaaatagaaagatatattaccatctgtattccaaattacaaaggtgaaaccaaaatttgaagaacgctgcttatgtacatcagttagcaagaaactcttatgtgctcgtcctttttttccccattttttgttac

SEQ ID NO: 1341 - DNA, 200 bp, Digitaria sanguinalis
cacagggtgttcctgatcgagtgaatgatgaggtttttattgcaatgtccaaggcactcaatttcataaatcctgatgagctatccatgcagtgcattttgattgctttgaaccgatttcttcaggtacatctgttgttgctctatgtgattgtgtaatacgtatactacttctgtttgaagaaatagtttacatatgtt

SEQ ID NO: 1342 - DNA, 200 bp, Digitaria sanguinalis
aacatatgtaaactatttcttcaaacagaagtagtatacgtattacacaatcacatagagcaacaacagatgtacctgaagaaatcggttcaaagcaatcaaaatgcactgcatggatagctcatcaggatttatgaaattgagtgccttggacattgcaataaaaacctcatcattcactcgatcaggaacaccctgtg

SEQ ID NO: 1343 - DNA, 200 bp, Digitaria sanguinalis
tttgaagaaatagtttacatatgttgattcttgctttcttttatgtattatttagttacctgagaaggttgctaatacgtatttgcatgtgggtattttgaaaagtttattttgtgtatacgtgcaggagaagcatggttcaaaaatggcattcttggatggtaatccacctgaaaggctgtgcctgcctattgttgatc

SEQ ID NO: 1344 - DNA, 200 bp, Digitaria sanguinalis
gatcaacaataggcaggcacagcctttcaggtggattaccatccaagaatgccatttttgaaccatgcttctcctgcacgtatacacaaaataaacttttcaaaatacccacatgcaaatacgtattagcaaccttctcaggtaactaaataatacataaaagaaagcaagaatcaacatatgtaaactatttcttcaaa

SEQ ID NO: 1345 - DNA, 200 bp, Digitaria sanguinalis
aggctgtgcctgcctattgttgatcacattcggtctaggggcggtgaggtccgcctgaattctcgtattaaaaagatagagctgaatcctgatggaactgtaaaacattttgcacttaccgatgggactcaaataactggagatgcttatgtttgtgctacaccaggtgtgatttattaccagtaaaccttgtttcctga

SEQ ID NO: 1346 - DNA, 200 bp, Digitaria sanguinalis
tcaggaaacaaggtttactggtaataaatcacacctggtgtagcacaaacataagcatctccagttatttgagtcccatcggtaagtgcaaaatgttttacagttccatcaggattcagctctatctttttaatacgagaattcaggcggacctcaccgcccctagaccgaatgtgatcaacaataggcaggcacagcct

SEQ ID NO: 1347 - DNA, 200 bp, Digitaria sanguinalis
attaccagtaaaccttgtttcctgacttcctgtgcagctatgcaactgaactgactagtcttcgtatttagttgatatcttcaagcttcttgtacctcaagagtggagtgaaatttcttatttcaagaagctggagaagctggtgggagttcctgttatcaatgttcatatatggttagttgatcgaaatatttggttct

SEQ ID NO: 1348 - DNA, 200 bp, Digitaria sanguinalis
agaaccaaatatttcgatcaactaaccatatatgaacattgataacaggaactcccaccagcttctccagcttcttgaaataagaaatttcactccactcttgaggtacaagaagcttgaagatatcaactaaatacgaagactagtcagttcagttgcatagctgcacaggaagtcaggaaacaaggtttactggtaat

SEQ ID NO: 1349 - DNA, 200 bp, Digitaria sanguinalis
ttagttgatcgaaatatttggttctgaattagaaatgcttcatttcctcgtatggttatgcttcttccttgaggcatttctgaagcttttctgagaacttctgttgttttgaatacctcaggtttgatagaaaactgaaaaatacgtatgaccaccttcttttcagcaggtattctcctgggcatatttgtagttcatgc

SEQ ID NO: 1350 - DNA, 200 bp, Digitaria sanguinalis
gcatgaactacaaatatgcccaggagaatacctgctgaaaagaaggtggtcatacgtatttttcagttttctatcaaacctgaggtattcaaaacaacagaagttctcagaaaagcttcagaaatgcctcaaggaagaagcataaccatacgaggaaatgaagcatttctaattcagaaccaaatatttcgatcaactaa

SEQ ID NO: 1351 - DNA, 200 bp, Digitaria sanguinalis
tttctttgattttctatgattttctaaagttttggagaaaaaactttggccatctatgattttccattttctatgattttttttattttctatgattttctaaagtttctatgattttctaaagttttggacaaaaatatttatggaggacatttgataagacatctatctataaagcccactttgacccatttaactag

SEQ ID NO: 1352 - DNA, 200 bp, Digitaria sanguinalis
ctagttaaatgggtcaaagtgggctttatagatagatgtcttatcaaatgtcctccataaatatttttgtccaaaactttagaaaatcatagaaactttagaaaatcatagaaaataaaaaaaatcatagaaaatggaaaatcatagatggccaaagttttttctccaaaactttagaaaatcatagaaaatcaaagaaa

SEQ ID NO: 1353 - DNA, 200 bp, Digitaria sanguinalis
agcccactttgacccatttaactaggataagtagaaataagaccaattaaagaatatttacttatacatgttcaacattttttgttaaacaagttcaacatttgataatgaaatgtcgacattgattaacctaaatgttgcaattggagaacagcaatattgaaatcaaagggccggaatgttgaatgctcaaatcataa

SEQ ID NO: 1354 - DNA, 200 bp, Digitaria sanguinalis
ttatgatttgagcattcaacattccggccctttgatttcaatattgctgttctccaattgcaacatttaggttaatcaatgtcgacatttcattatcaaatgttgaacttgtttaacaaaaaatgttgaacatgtataagtaaatattctttaattggtcttatttctacttatcctagttaaatgggtcaaagtgggct

SEQ ID NO: 1355 - DNA, 200 bp, Digitaria sanguinalis
ggaatgttgaatgctcaaatcataaatgttgaatgctaacatcaccaatgatgaactttatctcgtcttctccgggcacggcggagcagcagcggcgtctaggccaggccgcgcgacagagcagtggcggcctaggccagggcgcatgcatggatagcgggagcggcggcggcgccggtgtggagcaggccatggtgcga

SEQ ID NO: 1356 - DNA, 200 bp, Digitaria sanguinalis
tcgcaccatggcctgctccacaccggcgccgccgccgctcccgctatccatgcatgcgccctggcctaggccgccactgctctgtcgcgcggcctggcctagacgccgctgctgctccgccgtgcccggagaagacgagataaagttcatcattggtgatgttagcattcaacatttatgatttgagcattcaacattcc

SEQ ID NO: 1357 - DNA, 200 bp, Digitaria sanguinalis
cggtgtggagcaggccatggtgcgatcagacttggccccatgagagggctccgacactgtgcgggtttggtcggtggtgggtgtggcaggatgacccgaggcttcctacataatttctatccatctgtgataagattttaatttctacatatttaatgtttgagatccgtataaataattacaactcttaaatctacacc

SEQ ID NO: 1358 - DNA, 200 bp, Digitaria sanguinalis
ggtgtagatttaagagttgtaattatttatacggatctcaaacattaaatatgtagaaattaaaatcttatcacagatggatagaaattatgtaggaagcctcgggtcatcctgccacacccaccaccgaccaaacccgcacagtgtcggagccctctcatggggccaagtctgatcgcaccatggcctgctccacaccg

SEQ ID NO: 1359 - DNA, 200 bp, Digitaria sanguinalis
taattacaactcttaaatctacacctctcaaaccctatctccctttctaatcccctgctccctctctcctacactacacctgccgcccaccgtgttaccaaatacgatacacttaaataggtgtatttacaatttatttgaaaatataaatagatagagtatataaatatctataattatgcaaaatttaaagtttaaca

SEQ ID NO: 1360 - DNA, 200 bp, Digitaria sanguinalis
tgttaaactttaaattttgcataattatagatatttatatactctatctatttatattttcaaataaattgtaaatacacctatttaagtgtatcgtatttggtaacacggtgggcggcaggtgtagtgtaggagagagggagcaggggattagaaagggagatagggtttgagaggtgtagatttaagagttgtaatta

SEQ ID NO: 1361 - DNA, 200 bp, Digitaria sanguinalis
attatgcaaaatttaaagtttaacaaaaatttgtgcaaagagataaaaaaaaggaaaactcaacactaaatagttgcagattgcgggtttccaatgaaaagtaaagcacacaactatttatgtgttggtttctctttttcatatctccttgcacaattttttgttcaaccagaaactttgcatgacgagagatgtttata

SEQ ID NO: 1362 - DNA, 200 bp, Digitaria sanguinalis
tataaacatctctcgtcatgcaaagtttctggttgaacaaaaaattgtgcaaggagatatgaaaaagagaaaccaacacataaatagttgtgtgctttacttttcattggaaacccgcaatctgcaactatttagtgttgagttttccttttttttatctctttgcacaaatttttgttaaactttaaattttgcataat

SEQ ID NO: 1363 - DNA, 200 bp, Digitaria sanguinalis
ctttgcatgacgagagatgtttataagctttatccatctatacttttagatgaattttagacgcaccgatttagtgtgctaccgtgtttggtaacacagtaacatttaaaatcctctgtcccaaaatttaagcattaattaaatatatatgctaaagttcctcatgccttgtggcctcatgtgggacctacgtactgttt

SEQ ID NO: 1364 - DNA, 200 bp, Digitaria sanguinalis
aaacagtacgtaggtcccacatgaggccacaaggcatgaggaactttagcatatatatttaattaatgcttaaattttgggacagaggattttaaatgttactgtgttaccaaacacggtagcacactaaatcggtgcgtctaaaattcatctaaaagtatagatggataaagcttataaacatctctcgtcatgcaaag

SEQ ID NO: 1365 - DNA, 200 bp, Digitaria sanguinalis
ctcatgtgggacctacgtactgtttatgtgggacccacgtgttatttaggtgagccctatgtaggacccacgtgctatttatgtgggacccacgtgccatttaggtgggacccacacactatttagagtgggacacactctctttggtggggcctgcttagtgggacccacaacaatattaagtgtctatgttaaaaatt

SEQ ID NO: 1366 - DNA, 200 bp, Digitaria sanguinalis
aatttttaacatagacacttaatattgttgtgggtcccactaagcaggccccaccaaagagagtgtgtcccactctaaatagtgtgtgggtcccacctaaatggcacgtgggtcccacataaatagcacgtgggtcctacatagggctcacctaaataacacgtgggtcccacataaacagtacgtaggtcccacatgag

SEQ ID NO: 1367 - DNA, 200 bp, Digitaria sanguinalis
atattaagtgtctatgttaaaaattatcgaggattgtttttccattctttgcggtataaatatatttatttttctatgtataaaaataatatctaactttgtatactacattcatttgtgatagttctaatattttttctactttgctttaagatcataaatttggaaaataagatcgaattatacattcattactaaat

SEQ ID NO: 1368 - DNA, 200 bp, Digitaria sanguinalis
atttagtaatgaatgtataattcgatcttattttccaaatttatgatcttaaagcaaagtagaaaaaatattagaactatcacaaatgaatgtagtatacaaagttagatattatttttatacatagaaaaataaatatatttataccgcaaagaatggaaaaacaatcctcgataatttttaacatagacacttaatat

SEQ ID NO: 1369 - DNA, 200 bp, Digitaria sanguinalis
tcgaattatacattcattactaaatttatctttccttctataaaaatttaaaaattagtgtaacataacacgtcacttcattagctatttctattaccacttagaaaaaagttatatagctcttaaatgatcattataattaaaaaatatgtaaacttaatattgcaattgagtatagtaagatgataaatttgtattga

SEQ ID NO: 1370 - DNA, 200 bp, Digitaria sanguinalis
tcaatacaaatttatcatcttactatactcaattgcaatattaagtttacatattttttaattataatgatcatttaagagctatataacttttttctaagtggtaatagaaatagctaatgaagtgacgtgttatgttacactaatttttaaatttttatagaaggaaagataaatttagtaatgaatgtataattcga

SEQ ID NO: 1371 - DNA, 200 bp, Digitaria sanguinalis
tagtaagatgataaatttgtattgagtttaacattttttatatagatgagcatggcgcgtcaacctgactagtatgttattagatttcccaattataacatttttaataaatttagacacttattctacttatctaggttcaccgaagattctataaatttagtgaaaggctagaaatatttatatattttgtaagggag

SEQ ID NO: 1372 - DNA, 200 bp, Digitaria sanguinalis
ctcccttacaaaatatataaatatttctagcctttcactaaatttatagaatcttcggtgaacctagataagtagaataagtgtctaaatttattaaaaatgttataattgggaaatctaataacatactagtcaggttgacgcgccatgctcatctatataaaaaatgttaaactcaatacaaatttatcatcttacta

SEQ ID NO: 1373 - DNA, 200 bp, Digitaria sanguinalis
aatatttatatattttgtaagggagggagtagacggagatggcaggttacacaatgaacgagctgccacgttgactcaaatagttgccacgtgttatctagtttctttaaaaagaaagcaccaagagaaaataagagagatgacgtggcggtatataccgcggagacgtagagcgcaccaggcgccaaaaggcatcctcc

SEQ ID NO: 1374 - DNA, 200 bp, Digitaria sanguinalis
ggaggatgccttttggcgcctggtgcgctctacgtctccgcggtatataccgccacgtcatctctcttattttctcttggtgctttctttttaaagaaactagataacacgtggcaactatttgagtcaacgtggcagctcgttcattgtgtaacctgccatctccgtctactccctcccttacaaaatatataaatatt

SEQ ID NO: 1375 - DNA, 200 bp, Digitaria sanguinalis
caccaggcgccaaaaggcatcctcctcctccacatcctcctcaccccgcgctcgtcgtgctcttgtccctttccaccgccccaaccaagtcaagtgcggaggaggccgcccgcctccccttatcatcgcgcgacacggcttcctccccacctgggctcctccgcctccacgccgctccccgctgccccgcctcccctagt

SEQ ID NO: 1376 - DNA, 200 bp, Digitaria sanguinalis
actaggggaggcggggcagcggggagcggcgtggaggcggaggagcccaggtggggaggaagccgtgtcgcgcgatgataaggggaggcgggcggcctcctccgcacttgacttggttggggcggtggaaagggacaagagcacgacgagcgcggggtgaggaggatgtggaggaggaggatgccttttggcgcctggtg

SEQ ID NO: 1377 - DNA, 200 bp, Digitaria sanguinalis
tccccgctgccccgcctcccctagtccctccctcctcctcatccggtaagtcctcgttgcctgctcacgctgcgtttccatttaatcacgcgggagtcaggtcaggcgggattcggttcccatggggatgggggcggctctcgtggtacctgcgaccggaaattattaacgggctatatagaaatgggggatttcttagg

SEQ ID NO: 1378 - DNA, 200 bp, Digitaria sanguinalis
cctaagaaatcccccatttctatatagcccgttaataatttccggtcgcaggtaccacgagagccgcccccatccccatgggaaccgaatcccgcctgacctgactcccgcgtgattaaatggaaacgcagcgtgagcaggcaacgaggacttaccggatgaggaggagggagggactaggggaggcggggcagcgggga

SEQ ID NO: 1379 - DNA, 200 bp, Digitaria sanguinalis
atatagaaatgggggatttcttagggtttgtgctttgaaggcattggaaaattgtgactggtttggggaattggcagttacaacttacatggagtagtctgcagttgttgggcacagagttttagcggtgttctggtagtgtttatagagtatggcacacattgtatagtatagggagacttttggttcaaatttaatat

SEQ ID NO: 1380 - DNA, 200 bp, Digitaria sanguinalis
atattaaatttgaaccaaaagtctccctatactatacaatgtgtgccatactctataaacactaccagaacaccgctaaaactctgtgcccaacaactgcagactactccatgtaagttgtaactgccaattccccaaaccagtcacaattttccaatgccttcaaagcacaaaccctaagaaatcccccatttctatat

SEQ ID NO: 1381 - DNA, 200 bp, Digitaria sanguinalis
gagacttttggttcaaatttaatattagacggtcatgctacaaaatgggaggtccaagttgtgtattctgtttcctttgcatcattgttaactcactgcttgttctcagcatagaataactaaatcaatgtgtaccaaccttgatcagtttacttacatacttggaagatgcgcgtaagaaatgatctcatgaactgcca

SEQ ID NO: 1382 - DNA, 200 bp, Digitaria sanguinalis
tggcagttcatgagatcatttcttacgcgcatcttccaagtatgtaagtaaactgatcaaggttggtacacattgatttagttattctatgctgagaacaagcagtgagttaacaatgatgcaaaggaaacagaatacacaacttggacctcccattttgtagcatgaccgtctaatattaaatttgaaccaaaagtctc

SEQ ID NO: 1383 - DNA, 200 bp, Digitaria sanguinalis
taagaaatgatctcatgaactgccagtctaatagctcctcttggttatgcagtagtctgcctctgcgtattggttaatcagagctgacaacaatcaccaaaagttgcttcgacatggatactggctgcctgtcatctatgaacatttctggagtgaaccaaacgagatcttttgcgggacagcttcctactcagagatgc

SEQ ID NO: 1384 - DNA, 200 bp, Digitaria sanguinalis
gcatctctgagtaggaagctgtcccgcaaaagatctcgtttggttcactccagaaatgttcatagatgacaggcagccagtatccatgtcgaagcaacttttggtgattgttgtcagctctgattaaccaatacgcagaggcagactactgcataaccaagaggagctattagactggcagttcatgagatcatttctta

SEQ ID NO: 1385 - DNA, 200 bp, Digitaria sanguinalis
gggacagcttcctactcagagatgcttttcaagtagtcacaacgcgagctttgctgtgaaatctctagttgtaaggaataaaggaagaaggtcacaccgtagacattctgctttgcaggttcagttttttgttcattttcttctccaattttcaggtcatttcttagtgaaaatatgattgattagcttttctgcagatt

SEQ ID NO: 1386 - DNA, 200 bp, Digitaria sanguinalis
aatctgcagaaaagctaatcaatcatattttcactaagaaatgacctgaaaattggagaagaaaatgaacaaaaaactgaacctgcaaagcagaatgtctacggtgtgaccttcttcctttattccttacaactagagatttcacagcaaagctcgcgttgtgactacttgaaaagcatctctgagtaggaagctgtccc

SEQ ID NO: 1387 - DNA, 200 bp, Digitaria sanguinalis
tgattgattagcttttctgcagattgtctgcaaggatttcccaagacctccactagaaaacacaataaactatttggaagctggacaactctcttcattttttagaagcagccaacgccccagtaaaccattacaggtcgtgattgctggcgcaggtccgacgtgatttgtgattaatgttttcacaaatctttttgtca

SEQ ID NO: 1388 - DNA, 200 bp, Digitaria sanguinalis
tgacaaaaagatttgtgaaaacattaatcacaaatcacgtcggacctgcgccagcaatcacgacctgtaatggtttactggggcgttggctgcttctaaaaaatgaagagagttgtccagcttccaaatagtttattgtgttttctagtggaggtcttgggaaatccttgcagacaatctgcagaaaagctaatcaatca

SEQ ID NO: 1389 - DNA, 200 bp, Digitaria sanguinalis
aatgttttcacaaatctttttgtcagttacttccagggtaataacagttgagttttagctttattaatttgtggtgtaacttttgcaggattggctggtctatcaacggcgaaatatctggcagacgctggtcataaacccatattgctcgaggcaagagatgttttgggtggaaaggtctgaaagatacttacatgatt

SEQ ID NO: 1390 - DNA, 200 bp, Digitaria sanguinalis
aatcatgtaagtatctttcagacctttccacccaaaacatctcttgcctcgagcaatatgggtttatgaccagcgtctgccagatatttcgccgttgatagaccagccaatcctgcaaaagttacaccacaaattaataaagctaaaactcaactgttattaccctggaagtaactgacaaaaagatttgtgaaaacatt

SEQ ID NO: 1391 - DNA, 200 bp, Digitaria sanguinalis
aggtctgaaagatacttacatgattgtttacaatgctcttaattgctcgcatccggtgttttcatcgtttgttcctttaatgattttttttttgtttttttgtttatgcactgaacagatagctgcttggaaggatgaagatggagactggtatgagactgggcttcatatcttttgtaagttacagtttctggtcctta

SEQ ID NO: 1392 - DNA, 200 bp, Digitaria sanguinalis
taaggaccagaaactgtaacttacaaaagatatgaagcccagtctcataccagtctccatcttcatccttccaagcagctatctgttcagtgcataaacaaaaaaacaaaaaaaaaatcattaaaggaacaaacgatgaaaacaccggatgcgagcaattaagagcattgtaaacaatcatgtaagtatctttcagacct

SEQ ID NO: 1393 - DNA, 200 bp, Digitaria sanguinalis
tgtaagttacagtttctggtccttaaggttgtcttcatgatattttattttctagattatttctattagaaacatacatttaatgtagacatgttaacaagctgttaaggcgcaccagcacacaaacttctaaagcacagttgtctatcgtgcttgtttatttcctttaaggaatatctgttttagtttgcaaaattatt

SEQ ID NO: 1394 - DNA, 200 bp, Digitaria sanguinalis
aataattttgcaaactaaaacagatattccttaaaggaaataaacaagcacgatagacaactgtgctttagaagtttgtgtgctggtgcgccttaacagcttgttaacatgtctacattaaatgtatgtttctaatagaaataatctagaaaataaaatatcatgaagacaaccttaaggaccagaaactgtaacttaca

SEQ ID NO: 1395 - DNA, 200 bp, Digitaria sanguinalis
atctgttttagtttgcaaaattattattgagaaaggagtttttttttaaattactaatagcgtgaaaatagcatggaaagtttgcaggctactaaaaaagcgtacatcagtgcatgttttaatgttacgtaaacgtgttgtatactccttattatccataatggcatagttgaatatctgttattctgttcacaagaaca

SEQ ID NO: 1396 - DNA, 200 bp, Digitaria sanguinalis
tgttcttgtgaacagaataacagatattcaactatgccattatggataataaggagtatacaacacgtttacgtaacattaaaacatgcactgatgtacgcttttttagtagcctgcaaactttccatgctattttcacgctattagtaatttaaaaaaaaactcctttctcaataataattttgcaaactaaaacagat

SEQ ID NO: 1397 - DNA, 200 bp, Digitaria sanguinalis
atctgttattctgttcacaagaacattcgattgctaccattcccttcatagcttatataacactgcgtgtatgtaaccatgcatttttgttttaagttggagcttatcccaacatacagaatttgtttggcgagcttggtattgaggaccgtttacaatggaaagaacactccatgatatttgccatgccgaacaagcca

SEQ ID NO: 1398 - DNA, 200 bp, Digitaria sanguinalis
tggcttgttcggcatggcaaatatcatggagtgttctttccattgtaaacggtcctcaataccaagctcgccaaacaaattctgtatgttgggataagctccaacttaaaacaaaaatgcatggttacatacacgcagtgttatataagctatgaagggaatggtagcaatcgaatgttcttgtgaacagaataacagat

SEQ ID NO: 1399 - DNA, 200 bp, Digitaria sanguinalis
gatatttgccatgccgaacaagccaggagaattcagccggtttgatttcccagaaactttgccagcacctgtaaatggtacgactatgcgattttggagttgttgcaactgatttcctagataatccagaaatacattctaatcttagtctactcattttgcttatggacagcattaacgcttccaattgatgctgtact

SEQ ID NO: 1400 - DNA, 200 bp, Digitaria sanguinalis
agtacagcatcaattggaagcgttaatgctgtccataagcaaaatgagtagactaagattagaatgtatttctggattatctaggaaatcagttgcaacaactccaaaatcgcatagtcgtaccatttacaggtgctggcaaagtttctgggaaatcaaaccggctgaattctcctggcttgttcggcatggcaaatatc

SEQ ID NO: 1401 - DNA, 200 bp, Digitaria sanguinalis
taacgcttccaattgatgctgtactatgattcaccactgtacttttaacaggaatttgggccatactgagaaataatgaaatgcttacctggccggaaaaggtgaagtttgctattgggcttcttccagccatggtcggcggtcaaccttatgttgaagctcaagatggcttaacagtttcagagtggatgaaaaagcag

SEQ ID NO: 1402 - DNA, 200 bp, Digitaria sanguinalis
ctgctttttcatccactctgaaactgttaagccatcttgagcttcaacataaggttgaccgccgaccatggctggaagaagcccaatagcaaacttcaccttttccggccaggtaagcatttcattatttctcagtatggcccaaattcctgttaaaagtacagtggtgaatcatagtacagcatcaattggaagcgtta

SEQ ID NO: 1403 - DNA, 200 bp, Digitaria sanguinalis
agtttcagagtggatgaaaaagcaggtacgaattcaatttgtcgattagactagtctctgtgtaacagaaatactgccatctcatcagtactagagagcttttagtttaccaatagattgtttccttttattttcttatcttcctgaagaagtacaggtagctccataaaatgctttatatgctcaaattcttaacttat

SEQ ID NO: 1404 - DNA, 200 bp, Digitaria sanguinalis
ataagttaagaatttgagcatataaagcattttatggagctacctgtacttcttcaggaagataagaaaataaaaggaaacaatctattggtaaactaaaagctctctagtactgatgagatggcagtatttctgttacacagagactagtctaatcgacaaattgaattcgtacctgctttttcatccactctgaaact

SEQ ID NO: 1405 - DNA, 200 bp, Digitaria sanguinalis
ttatatgctcaaattcttaacttatatttggtgtaaatctttttctgtgaaaattaagacagagcaatgcttatagatgcattaacttggccagttaaaggccagcaatgttcatcatgttaagttcagcaatgtaccaaaaaaatgaaaaaaaaaaaacacacaagagacataatggtttcttgctaactgatacacat

SEQ ID NO: 1406 - DNA, 200 bp, Digitaria sanguinalis
atgtgtatcagttagcaagaaaccattatgtctcttgtgtgttttttttttttcatttttttggtacattgctgaacttaacatgatgaacattgctggcctttaactggccaagttaatgcatctataagcattgctctgtcttaattttcacagaaaaagatttacaccaaatataagttaagaatttgagcatataa

SEQ ID NO: 1407 - DNA, 200 bp, Digitaria sanguinalis
tggtttcttgctaactgatacacatgccgttttcttcaaaaattggtttcacctttgtcgtttggaatacagatggtaatatatctttctatttttctgtggagatatgtggtgcctgatacaattatttgatcagcacagggtgttcctgaccgagtgaatgatgaggtttttattgcaatgtccaaggcactcaattt

SEQ ID NO: 1408 - DNA, 200 bp, Digitaria sanguinalis
aaattgagtgccttggacattgcaataaaaacctcatcattcactcggtcaggaacaccctgtgctgatcaaataattgtatcaggcaccacatatctccacagaaaaatagaaagatatattaccatctgtattccaaacgacaaaggtgaaaccaatttttgaagaaaacggcatgtgtatcagttagcaagaaacca

SEQ ID NO: 1409 - DNA, 200 bp, Digitaria sanguinalis
ttgcaatgtccaaggcactcaatttcataaatcctgatgagctatccatgcagtgcattttgattgctttgaaccgatttcttcaggtacatctgttgttgctctatgttattgtgtaatatattacttgcctgttctgtttggagaaatagcttacatatgttgattcttgctttcttgtctgtactctgtattatttt

SEQ ID NO: 1410 - DNA, 200 bp, Digitaria sanguinalis
aaaataatacagagtacagacaagaaagcaagaatcaacatatgtaagctatttctccaaacagaacaggcaagtaatatattacacaataacatagagcaacaacagatgtacctgaagaaatcggttcaaagcaatcaaaatgcactgcatggatagctcatcaggatttatgaaattgagtgccttggacattgcaa

SEQ ID NO: 1411 - DNA, 200 bp, Digitaria sanguinalis
tcttgtctgtactctgtattatttttgaactgagagagatgccaatatgtatttgcatgtgggtattttgtgtaaacgtgcaggagaagcatggctcaaaaatggcattcttggatggtaatccacctgaaaggctgtgcatgcctattgttgatcacattcggtctaggggtggtgaagttcgcctgaattctcgtatt

SEQ ID NO: 1412 - DNA, 200 bp, Digitaria sanguinalis
aatacgagaattcaggcgaacttcaccacccctagaccgaatgtgatcaacaataggcatgcacagcctttcaggtggattaccatccaagaatgccatttttgagccatgcttctcctgcacgtttacacaaaatacccacatgcaaatacatattggcatctctctcagttcaaaaataatacagagtacagacaaga

SEQ ID NO: 1413 - DNA, 200 bp, Digitaria sanguinalis
tgaagttcgcctgaattctcgtattaaaaagatagagctgaatcctgatggaactgtaaaacattttgcacttaccgacggaactcaaataactggagatgcttatgtttgtgctacaccaggtgtgatttattaccagtaaaccttgtttcctgtgcagctatactgctatacaactgaagtactgaactgacaagtct

SEQ ID NO: 1414 - DNA, 200 bp, Digitaria sanguinalis
agacttgtcagttcagtacttcagttgtatagcagtatagctgcacaggaaacaaggtttactggtaataaatcacacctggtgtagcacaaacataagcatctccagttatttgagttccgtcggtaagtgcaaaatgttttacagttccatcaggattcagctctatctttttaatacgagaattcaggcgaacttca

SEQ ID NO: 1415 - DNA, 200 bp, Digitaria sanguinalis
actgaagtactgaactgacaagtctttgtatttagttgatatcttcaagcttcttgtacctcaagagtggagtgaaatatcttatttcaagaagctggagaagttggtgggagttcctgttatcaatgttcatatatggttagttaattgaaatatttggttctgaattggaaatgctccatttccttatatggttatgc

SEQ ID NO: 1416 - DNA, 200 bp, Digitaria sanguinalis
gcataaccatataaggaaatggagcatttccaattcagaaccaaatatttcaattaactaaccatatatgaacattgataacaggaactcccaccaacttctccagcttcttgaaataagatatttcactccactcttgaggtacaagaagcttgaagatatcaactaaatacaaagacttgtcagttcagtacttcagt

SEQ ID NO: 1417 - DNA, 200 bp, Digitaria sanguinalis
gctccatttccttatatggttatgcttcttccttgaggcatttctgaagctttgctgagaactgttgttttgaatgcctcaggtttgacagaaaactaaaaaacacatatgaccaccttcttttcagcaggtacatcttctggccatattcttagttcatgcattttttgtgcaatatttcttgattcatgcactgttca

SEQ ID NO: 1418 - DNA, 200 bp, Digitaria sanguinalis
tgaacagtgcatgaatcaagaaatattgcacaaaaaatgcatgaactaagaatatggccagaagatgtacctgctgaaaagaaggtggtcatatgtgttttttagttttctgtcaaacctgaggcattcaaaacaacagttctcagcaaagcttcagaaatgcctcaaggaagaagcataaccatataaggaaatggagc

SEQ ID NO: 1419 - DNA, 200 bp, Digitaria sanguinalis
tatttcttgattcatgcactgttcaggttgtgcacatttactgttgatggtattaaataccatatggcccttgttgatcttgtcagtaacctgcattttttttcaggagttcactgttaagtgtttatgcagacatgtcagtaacctgcaaggtaccgactatcatcttcagggcaatatcagttttgttcaaacactag

SEQ ID NO: 1420 - DNA, 200 bp, Digitaria sanguinalis
ctagtgtttgaacaaaactgatattgccctgaagatgatagtcggtaccttgcaggttactgacatgtctgcataaacacttaacagtgaactcctgaaaaaaaatgcaggttactgacaagatcaacaagggccatatggtatttaataccatcaacagtaaatgtgcacaacctgaacagtgcatgaatcaagaaata

SEQ ID NO: 1421 - DNA, 200 bp, Digitaria sanguinalis
aatatcagttttgttcaaacactagcatactaatacattggccatgatttcttcattaattctagaggctcagtgacctttacatgcgtcatctacataaacggtcctagggctcagatgattaagaaagaattcattataagtggaaatataaatatcttgcacattaaaaattttggacatctgtgctagatgtattg

SEQ ID NO: 1422 - DNA, 200 bp, Digitaria sanguinalis
caatacatctagcacagatgtccaaaatttttaatgtgcaagatatttatatttccacttataatgaattctttcttaatcatctgagccctaggaccgtttatgtagatgacgcatgtaaaggtcactgagcctctagaattaatgaagaaatcatggccaatgtattagtatgctagtgtttgaacaaaactgatatt

SEQ ID NO: 1423 - DNA, 200 bp, Digitaria sanguinalis
ttggacatctgtgctagatgtattgaagtgtgtgactttgtcattgcttacatgtcagtggtcactgtgttgtattgatgaatcatgatatgttaaatagcgaaggacatgattgcagattgcacactcaccttttttctttccttttgttgtctaattctttacaggaatactatgatccaaaccgttcaatgttggag

SEQ ID NO: 1424 - DNA, 200 bp, Digitaria sanguinalis
ctccaacattgaacggtttggatcatagtattcctgtaaagaattagacaacaaaaggaaagaaaaaaggtgagtgtgcaatctgcaatcatgtccttcgctatttaacatatcatgattcatcaatacaacacagtgaccactgacatgtaagcaatgacaaagtcacacacttcaatacatctagcacagatgtccaa

SEQ ID NO: 1425 - DNA, 200 bp, Digitaria sanguinalis
tgatccaaaccgttcaatgttggagttggtctttgctcctgcagaggaatggattggacgaagtgaaactgaaatcattgatgcaactatggaagagctagccaagttatttcctgatgaaattgctgccgatcagagtaaagcaaagatccttaagtatcatgttgtcaagacaccaaggtgaggatatttgtcggaca

SEQ ID NO: 1426 - DNA, 200 bp, Digitaria sanguinalis
tgtccgacaaatatcctcaccttggtgtcttgacaacatgatacttaaggatctttgctttactctgatcggcagcaatttcatcaggaaataacttggctagctcttccatagttgcatcaatgatttcagtttcacttcgtccaatccattcctctgcaggagcaaagaccaactccaacattgaacggtttggatca

SEQ ID NO: 1427 - DNA, 200 bp, Digitaria sanguinalis
ccaaggtgaggatatttgtcggacacttctgatagataagcaagtagctctagctctgacagttttttgtgttgtttccttttgttcatattctggcttgctttgacagatcggtttacaaaactgttccaaactgtgaaccttgtcgacctcttcaaaggtcaccgatcgaagggttctatttggctggtgattacaca

SEQ ID NO: 1428 - DNA, 200 bp, Digitaria sanguinalis
tgtgtaatcaccagccaaatagaacccttcgatcggtgacctttgaagaggtcgacaaggttcacagtttggaacagttttgtaaaccgatctgtcaaagcaagccagaatatgaacaaaaggaaacaacacaaaaaactgtcagagctagagctacttgcttatctatcagaagtgtccgacaaatatcctcaccttgg

SEQ ID NO: 1429 - DNA, 200 bp, Digitaria sanguinalis
gttctatttggctggtgattacacaaagcagaaatacttggcttccatggaaggtgcagtattatctgggaagctttgcgcccaatctatagtgcaggtaaatacacgccatgttccttgctgtacataaaagcatcggattgcttataagtttgatcgtttcgatgtgatacatttttgcagctaattatttaacatct

SEQ ID NO: 1430 - DNA, 200 bp, Digitaria sanguinalis
agatgttaaataattagctgcaaaaatgtatcacatcgaaacgatcaaacttataagcaatccgatgcttttatgtacagcaaggaacatggcgtgtatttacctgcactatagattgggcgcaaagcttcccagataatactgcaccttccatggaagccaagtatttctgctttgtgtaatcaccagccaaatagaac

SEQ ID NO: 1431 - DNA, 200 bp, Digitaria sanguinalis
ttttgcagctaattatttaacatctgctgctttcaggattatggcaggctctccctcaggagccagaaaagcctgcaatccgaagaagttcctgtcgcatcttaggcatagttcaggctcccatttggtgtgtcatcttatcacctatttcgtgggaacccaccaactgctcatgttgagggacctgacctcttgtgccc

SEQ ID NO: 1432 - DNA, 200 bp, Digitaria sanguinalis
gggcacaagaggtcaggtccctcaacatgagcagttggtgggttcccacgaaataggtgataagatgacacaccaaatgggagcctgaactatgcctaagatgcgacaggaacttcttcggattgcaggcttttctggctcctgagggagagcctgccataatcctgaaagcagcagatgttaaataattagctgcaaaa

SEQ ID NO: 1433 - DNA, 40 bp, Euphorbia heterophylla; identical to SEQ ID NO: 56

SEQ ID NO: 1434 - DNA, 40 bp, Euphorbia heterophylla
taaactatttacaaatttactgtccaaccataaataattt

SEQ ID NO: 1435 - DNA, 200 bp, Euphorbia heterophylla
aatgtttatggaagggaaaaaatgtgaaatattctgacagacaactaaaattcaataccaatcataaaaaatttaatgaatgattgagattgaccgaaatttacaaatgtatcaaagttcaaatttagagaatccttttacaaactcttatacaagtcacaaattgttaggatgaaaaattatgacttcaaacatcaatc

SEQ ID NO: 1436 - DNA, 200 bp, Euphorbia heterophylla
gattgatgtttgaagtcataatttttcatcctaacaatttgtgacttgtataagagtttgtaaaaggattctctaaatttgaactttgatacatttgtaaatttcggtcaatctcaatcattcattaaattttttatgattggtattgaattttagttgtctgtcagaatatttcacattttttcccttccataaacatt

SEQ ID NO: 1437 - DNA, 200 bp, Euphorbia heterophylla
aaaattatgacttcaaacatcaatcgatacatttaaaaaattatcactcacatcatcaatctatacatgtatgaaatggaaaaatatcactccttatgttaaccgatacaacttcacagtggttgttatatgaaaagatacctttgaagctcaatttaagagtaaccggtaatccttgctggcagaatattctcaacgga

SEQ ID NO: 1438 - DNA, 200 bp, Euphorbia heterophylla
tccgttgagaatattctgccagcaaggattaccggttactcttaaattgagcttcaaaggtatcttttcatataacaaccactgtgaagttgtatcggttaacataaggagtgatatttttccatttcatacatgtatagattgatgatgtgagtgataattttttaaatgtatcgattgatgtttgaagtcataatttt

SEQ ID NO: 1439 - DNA, 200 bp, Euphorbia heterophylla
ttgctggcagaatattctcaacggagaccatacaaaatccaacgctcaataatccaaaaatccatttccacttttccgacctactcctcttcctctttgttatcttcttcttcgtcttgcaatttccaatttctttgtttccaatttctgagttcactgatttctgccctcttcttcttcttcttcttcttcttcttcaa

SEQ ID NO: 1440 - DNA, 200 bp, Euphorbia heterophylla
ttgaagaagaagaagaagaagaagaagaagagggcagaaatcagtgaactcagaaattggaaacaaagaaattggaaattgcaagacgaagaagaagataacaaagaggaagaggagtaggtcggaaaagtggaaatggatttttggattattgagcgttggattttgtatggtctccgttgagaatattctgccagcaa

SEQ ID NO: 1441 - DNA, 200 bp, Euphorbia heterophylla
tcttcttcttcttcttcttcttcaattgattttgagcttcaattgatatattactatgacactttatgggggcgtttctccattgaacttgacctttcattctgatatctcagaagctagaaatttgctatcctctttcagatgtcaaaatcatctgctctcttttaaaagcagcgaatctttgggttctcctctgagaa

SEQ ID NO: 1442 - DNA, 200 bp, Euphorbia heterophylla
ttctcagaggagaacccaaagattcgctgcttttaaaagagagcagatgattttgacatctgaaagaggatagcaaatttctagcttctgagatatcagaatgaaaggtcaagttcaatggagaaacgcccccataaagtgtcatagtaatatatcaattgaagctcaaaatcaattgaagaagaagaagaagaagaaga

SEQ ID NO: 1443 - DNA, 200 bp, Euphorbia heterophylla
gaatctttgggttctcctctgagaacttctattggaaatgctaccaaaacacgatcaaggactgctggttcgtctttgaaggttcgatttattctttttcgtatctttcgccctcgtttttcctttgttcttgttacagtatgtttgcctacttgattgatgatacaggtggtttgtgtggactaccctagacctgatat

SEQ ID NO: 1444 - DNA, 200 bp, Euphorbia heterophylla
atatcaggtctagggtagtccacacaaaccacctgtatcatcaatcaagtaggcaaacatactgtaacaagaacaaaggaaaaacgagggcgaaagatacgaaaaagaataaatcgaaccttcaaagacgaaccagcagtccttgatcgtgttttggtagcatttccaatagaagttctcagaggagaacccaaagattc

SEQ ID NO: 1445 - DNA, 200 bp, Euphorbia heterophylla
gtgtggactaccctagacctgatattgacaatactgcaaattttctcgaagctgcttacttgtcttcaacctttcgtgcttctcctcgtccggataaacctttgaaggttgtaattgccggtgcaggtgatcaatttcttatcctaattggttttcttgcttatttcagttcagtgctttttgaagtatgcttgcttcaa

SEQ ID NO: 1446 - DNA, 200 bp, Euphorbia heterophylla
ttgaagcaagcatacttcaaaaagcactgaactgaaataagcaagaaaaccaattaggataagaaattgatcacctgcaccggcaattacaaccttcaaaggtttatccggacgaggagaagcacgaaaggttgaagacaagtaagcagcttcgagaaaatttgcagtattgtcaatatcaggtctagggtagtccacac

SEQ ID NO: 1447 - DNA, 200 bp, Euphorbia heterophylla
gctttttgaagtatgcttgcttcaattttgatttatgggtaggcagggactacaattgattgatttttattttagttttagcgtttaaacattttatttctggaagctgttgtccaagtcaataacttagcatcttgaataaaatctgcaaacttttgtggttatttatatacctcttctgatttggttacaatggatta

SEQ ID NO: 1448 - DNA, 200 bp, Euphorbia heterophylla
taatccattgtaaccaaatcagaagaggtatataaataaccacaaaagtttgcagattttattcaagatgctaagttattgacttggacaacagcttccagaaataaaatgtttaaacgctaaaactaaaataaaaatcaatcaattgtagtccctgcctacccataaatcaaaattgaagcaagcatacttcaaaaagc

SEQ ID NO: 1449 - DNA, 200 bp, Euphorbia heterophylla
cttctgatttggttacaatggattaacaacttttacatcatgctgcagggttggctggtttatcaacggcaaaatatttagcagatgcagggcacaagcctttattacttgaagcaagagatgttcttggaggaaaggttatgctttacctagacttcaagaaaattatgcattgagttaccaattattaaacaatatga

SEQ ID NO: 1450 - DNA, 200 bp, Euphorbia heterophylla
tcatattgtttaataattggtaactcaatgcataattttcttgaagtctaggtaaagcataacctttcctccaagaacatctcttgcttcaagtaataaaggcttgtgccctgcatctgctaaatattttgccgttgataaaccagccaaccctgcagcatgatgtaaaagttgttaatccattgtaaccaaatcagaag

SEQ ID NO: 1451 - DNA, 200 bp, Euphorbia heterophylla
agttaccaattattaaacaatatgaataacaattggtgcaagcaaatgaattggattatagactctgtttgtttgattattgatcttatatagtatatttatttcttatttcttaagactaattcatgggagtctaagagttccatttgctaatgaatatctggcatgtgcttttcgaaatcaatgtcgcaattattatt

SEQ ID NO: 1452 - DNA, 200 bp, Euphorbia heterophylla
aataataattgcgacattgatttcgaaaagcacatgccagatattcattagcaaatggaactcttagactcccatgaattagtcttaagaaataagaaataaatatactatataagatcaataatcaaacaaacagagtctataatccaattcatttgcttgcaccaattgttattcatattgtttaataattggtaact

SEQ ID NO: 1453 - DNA, 200 bp, Euphorbia heterophylla
cgaaatcaatgtcgcaattattattatgatttagctatctagtaggtgcctttggtgcacgttatgcacaccatggacattatttagttgataagcttctgattctcttgtttcaaagtcattaccatgaattaactttctcttatgcttggttcgtattttattttctattcatatactagttttaataattgacattg

SEQ ID NO: 1454 - DNA, 200 bp, Euphorbia heterophylla
caatgtcaattattaaaactagtatatgaatagaaaataaaatacgaaccaagcataagagaaagttaattcatggtaatgactttgaaacaagagaatcagaagcttatcaactaaataatgtccatggtgtgcataacgtgcaccaaaggcacctactagatagctaaatcataataataattgcgacattgatttcg

SEQ ID NO: 1455 - DNA, 200 bp, Euphorbia heterophylla
atactagttttaataattgacattgctgcttaaatgctgttctgggtgggcatcactgacatttaatatgacaagttgaagttcttcattgccgcatatatggttgagttccttcacagttcatgcaaatggtcaagacaattgactttctcttagaagaaagttttcctattttttaacttgaaaggttataatctatg

SEQ ID NO: 1456 - DNA, 200 bp, Euphorbia heterophylla
catagattataacctttcaagttaaaaaataggaaaactttcttctaagagaaagtcaattgtcttgaccatttgcatgaactgtgaaggaactcaaccatatatgcggcaatgaagaacttcaacttgtcatattaaatgtcagtgatgcccacccagaacagcatttaagcagcaatgtcaattattaaaactagtat

SEQ ID NO: 1457 - DNA, 200 bp, Euphorbia heterophylla
ttaacttgaaaggttataatctatgtcctgtttatatgtgctatagtctcatagttgttttcattaaataggtggctgcatggaaagataaagatggggactggtatgagacaggcttgcatatattctgtaagtttcagaacccttttggagtcattgtaatgccacttccatactcgatgtgttgttgttactttcca

SEQ ID NO: 1458 - DNA, 200 bp, Euphorbia heterophylla
tggaaagtaacaacaacacatcgagtatggaagtggcattacaatgactccaaaagggttctgaaacttacagaatatatgcaagcctgtctcataccagtccccatctttatctttccatgcagccacctatttaatgaaaacaactatgagactatagcacatataaacaggacatagattataacctttcaagttaa

SEQ ID NO: 1459 - DNA, 200 bp, Euphorbia heterophylla
ctcgatgtgttgttgttactttccaccttttttgtcaaatcaatttcatagtttcctttgacatgaagatgcaggaaatattttgtatattaatttttttttaaaatattttgctggttgttgtgaatagacattgttaattttatgctggacagagttttctttttccttatttgtttcagatgcttaaacttttgtgg

SEQ ID NO: 1460 - DNA, 200 bp, Euphorbia heterophylla
ccacaaaagtttaagcatctgaaacaaataaggaaaaagaaaactctgtccagcataaaattaacaatgtctattcacaacaaccagcaaaatattttaaaaaaaaattaatatacaaaatatttcctgcatcttcatgtcaaaggaaactatgaaattgatttgacaaaaaaggtggaaagtaacaacaacacatcgag

SEQ ID NO: 1461 - DNA, 200 bp, Euphorbia heterophylla
gtttcagatgcttaaacttttgtggtatattgctgttcttattgaacctgtcttctttggtttacaagttggagcatatccaaatgtgcagaacctgtttggagagctaaacatcaatgataggctgcagtggaaggagcattctatgatatttgcaatgccaagcaagccaggggagttcagtcgatttgactttcctg

SEQ ID NO: 1462 - DNA, 200 bp, Euphorbia heterophylla
caggaaagtcaaatcgactgaactcccctggcttgcttggcattgcaaatatcatagaatgctccttccactgcagcctatcattgatgtttagctctccaaacaggttctgcacatttggatatgctccaacttgtaaaccaaagaagacaggttcaataagaacagcaatataccacaaaagtttaagcatctgaaac

SEQ ID NO: 1463 - DNA, 200 bp, Euphorbia heterophylla
gagttcagtcgatttgactttcctgatgttcttccagcacctttaaacggtatacaagttaaacacttcctgaaaattgatttctcatgtgcaactttttaggagctagcgagacctataaaaattgttggtaagcataggaattgtatatttggcttaaattttatgaatggaaacaattgtattttagttgaaaacca

SEQ ID NO: 1464 - DNA, 200 bp, Euphorbia heterophylla
tggttttcaactaaaatacaattgtttccattcataaaatttaagccaaatatacaattcctatgcttaccaacaatttttataggtctcgctagctcctaaaaagttgcacatgagaaatcaattttcaggaagtgtttaacttgtataccgtttaaaggtgctggaagaacatcaggaaagtcaaatcgactgaactc

SEQ ID NO: 1465 - DNA, 200 bp, Euphorbia heterophylla
acaattgtattttagttgaaaaccagattgaatcattgaactcttatcatgtaactcttatatttcattgattttttttgtatttttcatatttctgctcacattgttgattttttgactaagcacccctttgttttctcagcagtcacctcctgattgttgtcctctacgtgagacagctcttgttgtagacatatcca

SEQ ID NO: 1466 - DNA, 200 bp, Euphorbia heterophylla
tggatatgtctacaacaagagctgtctcacgtagaggacaacaatcaggaggtgactgctgagaaaacaaaggggtgcttagtcaaaaaatcaacaatgtgagcagaaatatgaaaaatacaaaaaaaatcaatgaaatataagagttacatgataagagttcaatgattcaatctggttttcaactaaaatacaattgt

SEQ ID NO: 1467 - DNA, 200 bp, Euphorbia heterophylla
acagctcttgttgtagacatatccatatatttgtatatcagccaaacatataccttaaatgtatgatttttaattgattctgtctaggcttcaagggatagctaaaaaaggacacatttctctgttttcttgtgggttttgttattgtgatctaggatataactagaggagtagaggttgtcatattataatacaacctt

SEQ ID NO: 1468 - DNA, 200 bp, Euphorbia heterophylla
aaggttgtattataatatgacaacctctactcctctagttatatcctagatcacaataacaaaacccacaagaaaacagagaaatgtgtccttttttagctatcccttgaagcctagacagaatcaattaaaaatcatacatttaaggtatatgtttggctgatatacaaatatatggatatgtctacaacaagagctgt

SEQ ID NO: 1469 - DNA, 200 bp, Euphorbia heterophylla
ggttgtcatattataatacaaccttcacaaattcatgatttgtggcaatggagaagtttagaatggtgagttaaaccgtattttggccttcagaagtacccaagatttacaatatgcgtattaattaatgataaatggaaatcaatttcccaatgtatatatcttaaataattgctctatatgcttctattttttttgtg

SEQ ID NO: 1470 - DNA, 200 bp, Euphorbia heterophylla
cacaaaaaaaatagaagcatatagagcaattatttaagatatatacattgggaaattgatttccatttatcattaattaatacgcatattgtaaatcttgggtacttctgaaggccaaaatacggtttaactcaccattctaaacttctccattgccacaaatcatgaatttgtgaaggttgtattataatatgacaacc

SEQ ID NO: 1471 - DNA, 200 bp, Euphorbia heterophylla
tctatatgcttctattttttttgtgatcttacaatttcctgtcatgcctaaatttttttatggttattcaacttatttatctatagaactatcattttttttttcaatttttgcttattttattgcatactttggtattacctgcaaaatattgcttaaaattaatgtatattttctatggttgtgcttgacagggatat

SEQ ID NO: 1472 - DNA, 200 bp, Euphorbia heterophylla
atatccctgtcaagcacaaccatagaaaatatacattaattttaagcaatattttgcaggtaataccaaagtatgcaataaaataagcaaaaattgaaaaaaaaaatgatagttctatagataaataagttgaataaccataaaaaaatttaggcatgacaggaaattgtaagatcacaaaaaaaatagaagcatataga

SEQ ID NO: 1473 - DNA, 200 bp, Euphorbia heterophylla
ctatggttgtgcttgacagggatatgggccattttaaaaaacaatgagatgctgacatggccggagaaagtgaaatttgctattggacttttgccagcaatgcttggtggacaggcatatgttgaggctcaagatggtttgagtgttcaagagtggatgagaaagcaggtacttttgatagatccaaatcaataagaata

SEQ ID NO: 1474 - DNA, 200 bp, Euphorbia heterophylla
tattcttattgatttggatctatcaaaagtacctgctttctcatccactcttgaacactcaaaccatcttgagcctcaacatatgcctgtccaccaagcattgctggcaaaagtccaatagcaaatttcactttctccggccatgtcagcatctcattgttttttaaaatggcccatatccctgtcaagcacaaccatag

SEQ ID NO: 1475 - DNA, 200 bp, Euphorbia heterophylla
tgatagatccaaatcaataagaataacacatggcttcttatgggcacaactctccagccaaggatcatggagtcgcattgatcatcgtgcaatttaaacagaagaaaccagaatactgaactaaaatactcaacattgctcgattaaaaattgatttattttctgaaactagtaaaatctatatatgtatcaagtataac

SEQ ID NO: 1476 - DNA, 200 bp, Euphorbia heterophylla
gttatacttgatacatatatagattttactagtttcagaaaataaatcaatttttaatcgagcaatgttgagtattttagttcagtattctggtttcttctgtttaaattgcacgatgatcaatgcgactccatgatccttggctggagagttgtgcccataagaagccatgtgttattcttattgatttggatctatca

SEQ ID NO: 1477 - DNA, 200 bp, Euphorbia heterophylla
aatctatatatgtatcaagtataacaaataaactctgttcttgatatatatattttttttgtaattttccgtgtttgattgtcagggtgttcctgatcgagtcactaaagaggtgttcattgccatgtcaaaggcactaaactttataaaccctgatgagctttcaatgcaatgtatattgatagcattgaacagatttc

SEQ ID NO: 1478 - DNA, 200 bp, Euphorbia heterophylla
gaaatctgttcaatgctatcaatatacattgcattgaaagctcatcagggtttataaagtttagtgcctttgacatggcaatgaacacctctttagtgactcgatcaggaacaccctgacaatcaaacacggaaaattacaaaaaaaatatatatatcaagaacagagtttatttgttatacttgatacatatatagatt

SEQ ID NO: 1479 - DNA, 200 bp, Euphorbia heterophylla
atattgatagcattgaacagatttcttcaggtatgatacttcttctttctctttctattcctcgatgagctttccattaatattttttgaatgaatgtttgttgaacaacattcatgtgtttagttggctgaaaagaagttttgctttttcttttcctttaaataaatgaaattcaaattttcttttacatttttctcag

SEQ ID NO: 1480 - DNA, 200 bp, Euphorbia heterophylla
ctgagaaaaatgtaaaagaaaatttgaatttcatttatttaaaggaaaagaaaaagcaaaacttcttttcagccaactaaacacatgaatgttgttcaacaaacattcattcaaaaaatattaatggaaagctcatcgaggaatagaaagagaaagaagaagtatcatacctgaagaaatctgttcaatgctatcaatat

SEQ ID NO: 1481 - DNA, 200 bp, Euphorbia heterophylla
aaattttcttttacatttttctcagttactcttgaagatgttattgttgaaagattgagcataagccttatataaactcattacaaatttttttatacttttgtcattttttctctattttctagaagtttctcaattttttctttgccacttcacattagatctgtggaagtttcttatataatgaaactaactgaata

SEQ ID NO: 1482 - DNA, 200 bp, Euphorbia heterophylla
tattcagttagtttcattatataagaaacttccacagatctaatgtgaagtggcaaagaaaaaattgagaaacttctagaaaatagagaaaaaatgacaaaagtataaaaaaatttgtaatgagtttatataaggcttatgctcaatctttcaacaataacatcttcaagagtaactgagaaaaatgtaaaagaaaattt

SEQ ID NO: 1483 - DNA, 200 bp, Euphorbia heterophylla
cttatataatgaaactaactgaataaggatcgatggtaatatcaacaggaaaagcatggttctaagatggctttcttggatggaaatcccccagagaggctttgcaagccaattgttgatcacattcagtccttgggtggtgaagtacggctaaattcacgaataaaaaaatttgatttaaataatgatggaacaattaa

SEQ ID NO: 1484 - DNA, 200 bp, Euphorbia heterophylla
ttaattgttccatcattatttaaatcaaatttttttattcgtgaatttagccgtacttcaccacccaaggactgaatgtgatcaacaattggcttgcaaagcctctctgggggatttccatccaagaaagccatcttagaaccatgcttttcctgttgatattaccatcgatccttattcagttagtttcattatataag

SEQ ID NO: 1485 - DNA, 200 bp, Euphorbia heterophylla
atttaaataatgatggaacaattaagagctttttactgagtaatggggatgtgatagaaggggatgcttatgtttttgccggtccaggtaaacttgaattttggataacaaataacttctattattttcgtgacccatattttctgatactagtgtatttttctttttcctttagttgatatattgaagcttcttttgcc

SEQ ID NO: 1486 - DNA, 200 bp, Euphorbia heterophylla
ggcaaaagaagcttcaatatatcaactaaaggaaaaagaaaaatacactagtatcagaaaatatgggtcacgaaaataatagaagttatttgttatccaaaattcaagtttacctggaccggcaaaaacataagcatccccttctatcacatccccattactcagtaaaaagctcttaattgttccatcattatttaaat

SEQ ID NO: 1487 - DNA, 200 bp, Euphorbia heterophylla
ttgatatattgaagcttcttttgcctgataactggaaagagattccttacttcaagaaattggataaattagttggagtccctgtcattaatgttcatatatggtcagtgatgaattcttttatcgagtgactgtttatctgagagttcatttactagcacatggttcactaacagaaatatatttcttttccaggtttg

SEQ ID NO: 1488 - DNA, 200 bp, Euphorbia heterophylla
caaacctggaaaagaaatatatttctgttagtgaaccatgtgctagtaaatgaactctcagataaacagtcactcgataaaagaattcatcactgaccatatatgaacattaatgacagggactccaactaatttatccaatttcttgaagtaaggaatctctttccagttatcaggcaaaagaagcttcaatatatcaa

SEQ ID NO: 1489 - DNA, 200 bp, Euphorbia heterophylla
gaaatatatttcttttccaggtttgaccggaaactaaagaatacatacgatcatctgcttttcagcaggtcctactcttatgcttttctctagctgttcttcgcccatagagatttctacaatcattttcataacttcctgaaaagctgttaattttcatcttttatgaaggaattcagttcattacaaatcattttacg

SEQ ID NO: 1490 - DNA, 200 bp, Euphorbia heterophylla
cgtaaaatgatttgtaatgaactgaattccttcataaaagatgaaaattaacagcttttcaggaagttatgaaaatgattgtagaaatctctatgggcgaagaacagctagagaaaagcataagagtaggacctgctgaaaagcagatgatcgtatgtattctttagtttccggtcaaacctggaaaagaaatatatttc

SEQ ID NO: 1491 - DNA, 200 bp, Euphorbia heterophylla
tcagttcattacaaatcattttacgtataaatattttgaatcttgtatgtaaaatgatttcaaatgaattgaattccttctaaaaggaatgttttccaatggagggttgagttgttgctataataagttgaccttctgaatctgatttgtaccaatgaagtttgaagaaatgccttttcccgtgctattgtacatactga

SEQ ID NO: 1492 - DNA, 200 bp, Euphorbia heterophylla
tcagtatgtacaatagcacgggaaaaggcatttcttcaaacttcattggtacaaatcagattcagaaggtcaacttattatagcaacaactcaaccctccattggaaaacattccttttagaaggaattcaattcatttgaaatcattttacatacaagattcaaaatatttatacgtaaaatgatttgtaatgaactga

SEQ ID NO: 1493 - DNA, 200 bp, Euphorbia heterophylla
tttcccgtgctattgtacatactgattgtatatcttcttttgacttgcagaagtccccttcttagtgtttatgctgacatgtctcttacatgcaaggtaaaactggaactagttatttattttaccaaaacgacttggctgctgctatgctaattacttttgttctatgaaatgaaaagtaatagtggtctgctttttgt

SEQ ID NO: 1494 - DNA, 200 bp, Euphorbia heterophylla
acaaaaagcagaccactattacttttcatttcatagaacaaaagtaattagcatagcagcagccaagtcgttttggtaaaataaataactagttccagttttaccttgcatgtaagagacatgtcagcataaacactaagaaggggacttctgcaagtcaaaagaagatatacaatcagtatgtacaatagcacgggaaa

SEQ ID NO: 1495 - DNA, 200 bp, Euphorbia heterophylla
aaagtaatagtggtctgctttttgtctccatacacataatttgggcaaataatatgatctttgtagtctttgacatgttaattacaaacattgaagcatctcaagtatcatcttgtaaaaactccccggttagcgacctattgtctacgaacttcttggctctgaccaaacgccttttgtctatgaactattgatttggg

SEQ ID NO: 1496 - DNA, 200 bp, Euphorbia heterophylla
cccaaatcaatagttcatagacaaaaggcgtttggtcagagccaagaagttcgtagacaataggtcgctaaccggggagtttttacaagatgatacttgagatgcttcaatgtttgtaattaacatgtcaaagactacaaagatcatattatttgcccaaattatgtgtatggagacaaaaagcagaccactattacttt

SEQ ID NO: 1497 - DNA, 200 bp, Euphorbia heterophylla
ggcagaagtccccttcttagtgtttatgctgacatgtctcttacatgcaaggaatattataatccaaatcaatcaatgctggagttggtatttgcacctgcagaagaatggatctcacgcacggacaccgagatcatagatgccactatgaaagaactcgcaaaactctttcccgatgaaatagctgcagaccaaagcaa

SEQ ID NO: 1498 - DNA, 200 bp, Euphorbia heterophylla
ttgctttggtctgcagctatttcatcgggaaagagttttgcgagttctttcatagtggcatctatgatctcggtgtccgtgcgtgagatccattcttctgcaggtgcaaataccaactccagcattgattgatttggattataatattccttgcatgtaagagacatgtcagcataaacactaagaaggggacttctgcc

SEQ ID NO: 1499 - DNA, 200 bp, Euphorbia heterophylla
atgaaatagctgcagaccaaagcaaagccaaaattctcaagtatcatgttgtaaagactccccggtcggtttacaagactatcccaaactgtgaaccatgccgccctttgcaaagatcacccgtggaggggttctatttagccggtgactacacaaagcagaagtatttggcttcaatggagggtgctgtcctatctggc

SEQ ID NO: 1500 - DNA, 200 bp, Euphorbia heterophylla
gccagataggacagcaccctccattgaagccaaatacttctgctttgtgtagtcaccggctaaatagaacccctccacgggtgatctttgcaaagggcggcatggttcacagtttgggatagtcttgtaaaccgaccggggagtctttacaacatgatacttgagaattttggctttgctttggtctgcagctatttcat

SEQ ID NO: 1501 - DNA, 200 bp, Euphorbia heterophylla
ggtaaaactggaactagttattttattttaccaaaatgacttggctgctgctatgctaattacttttggtctatgaaacgaaaagtaatagtggtctgctttttgtctctatacacgtaatttgggcaaataatatgatttcggtcaatgagggtcctaaagtgttttatttcacttgattttgtggtcccttgagcatg

SEQ ID NO: 1502 - DNA, 200 bp, Euphorbia heterophylla
catgctcaagggaccacaaaatcaagtgaaataaaacactttaggaccctcattgaccgaaatcatattatttgcccaaattacgtgtatagagacaaaaagcagaccactattacttttcgtttcatagaccaaaagtaattagcatagcagcagccaagtcattttggtaaaataaaataactagttccagttttacc

SEQ ID NO: 1503 - DNA, 200 bp, Euphorbia heterophylla
ttgattttgtggtcccttgagcatgcttaatttctaggtttgagatgatgtacaaaaatgtcctcacggttgaatggtatttttggctcactacagtcctcaagcgaattaaatttttactgtttatttaacaaaaagtactaaatcacaatttcttggggcacaggaatattataatccaaaccaatcaatgctggagt

SEQ ID NO: 1504 - DNA, 200 bp, Euphorbia heterophylla
actccagcattgattggtttggattataatattcctgtgccccaagaaattgtgatttagtactttttgttaaataaacagtaaaaatttaattcgcttgaggactgtagtgagccaaaaataccattcaaccgtgaggacatttttgtacatcatctcaaacctagaaattaagcatgctcaagggaccacaaaatcaa

SEQ ID NO: 1505 - DNA, 200 bp, Euphorbia heterophylla
aatccaaaccaatcaatgctggagttggtatttgcacctgcagaagaatggatctcatgcacagacaccgagatcatagatgccacaatgaaagaactcgctaaactctttcccgatgaaatagctgccgaccagagcaaagccaaaattctcaagtatcatgtcgtaaaaactccccggttagtctcctttaaaaaatt

SEQ ID NO: 1506 - DNA, 200 bp, Euphorbia heterophylla
aattttttaaaggagactaaccggggagtttttacgacatgatacttgagaattttggctttgctctggtcggcagctatttcatcgggaaagagtttagcgagttctttcattgtggcatctatgatctcggtgtctgtgcatgagatccattcttctgcaggtgcaaataccaactccagcattgattggtttggatt

SEQ ID NO: 1507 - DNA, 200 bp, Euphorbia heterophylla
cccggttagtctcctttaaaaaattgcatccttgattagtatctcacatgttttgaaaaccggacccgaccggcccggtcagaccaggttcgactggaaccagccactggcccggtcggttttcagttgattcttaatccagtaaaaaaccagctgttgtccggttataccttaagtccagtttgaccaccgatttggtt

SEQ ID NO: 1508 - DNA, 200 bp, Euphorbia heterophylla
aaccaaatcggtggtcaaactggacttaaggtataaccggacaacagctggttttttactggattaagaatcaactgaaaaccgaccgggccagtggctggttccagtcgaacctggtctgaccgggccggtcgggtccggttttcaaaacatgtgagatactaatcaaggatgcaattttttaaaggagactaaccggg

SEQ ID NO: 1509 - DNA, 200 bp, Euphorbia heterophylla
gtaaaactggaactagttatttattttaccaaaacgacttggctgctgctatgctaattacttttgttctatgaaatgaaaagtaatagtggtctgctttttgtctccatacacataatttgggcaaataatatgatctttgtagtctttgacatgttaattacaaacattgaagcatctcaagtatcatcttgtaaaaa

SEQ ID NO: 1510 - DNA, 200 bp, Euphorbia heterophylla
tttttacaagatgatacttgagatgcttcaatgtttgtaattaacatgtcaaagactacaaagatcatattatttgcccaaattatgtgtatggagacaaaaagcagaccactattacttttcatttcatagaacaaaagtaattagcatagcagcagccaagtcgttttggtaaaataaataactagttccagttttac

SEQ ID NO: 1511 - DNA, 200 bp, Euphorbia heterophylla
catctcaagtatcatcttgtaaaaactccccggttagcgacctattgtctacgaacttcttggctctgaccaaacgccttttgtctatgaactattgatttggggaatttggttcttgacctattgtactcactctagcacgtataacccacaaattagatttgcaactttgctcaatttatatcaatacatgtaaaata

SEQ ID NO: 1512 - DNA, 200 bp, Euphorbia heterophylla
tattttacatgtattgatataaattgagcaaagttgcaaatctaatttgtgggttatacgtgctagagtgagtacaataggtcaagaaccaaattccccaaatcaatagttcatagacaaaaggcgtttggtcagagccaagaagttcgtagacaataggtcgctaaccggggagtttttacaagatgatacttgagatg

SEQ ID NO: 1513 - DNA, 200 bp, Euphorbia heterophylla
aatttatatcaatacatgtaaaatagtcaacattatactgcacatctattatcaattgctttaggtatgaccctaatgtctctggtcaataggtcagggacccaaggggaacatctcgatcaatcagcgtccttaagtctagtttttcacttgaatttgtggtcccttgagcttgcttaatttctaggtttgagatgatg

SEQ ID NO: 1514 - DNA, 200 bp, Euphorbia heterophylla
catcatctcaaacctagaaattaagcaagctcaagggaccacaaattcaagtgaaaaactagacttaaggacgctgattgatcgagatgttccccttgggtccctgacctattgaccagagacattagggtcatacctaaagcaattgataatagatgtgcagtataatgttgactattttacatgtattgatataaatt

SEQ ID NO: 1515 - DNA, 200 bp, Euphorbia heterophylla
cttaatttctaggtttgagatgatgtacaaaaacgtcctcacggttgaatggcatttgggctcactacagtcctcaagtgaattaaactttttacactgtttatttaacaaaaagtactaaatcacaatttcttgtggcacaggaatattataatccaaatcaatcaatgctggagttggtatttgcacctgcagaagaa

SEQ ID NO: 1516 - DNA, 200 bp, Euphorbia heterophylla
ttcttctgcaggtgcaaataccaactccagcattgattgatttggattataatattcctgtgccacaagaaattgtgatttagtactttttgttaaataaacagtgtaaaaagtttaattcacttgaggactgtagtgagcccaaatgccattcaaccgtgaggacgtttttgtacatcatctcaaacctagaaattaag

SEQ ID NO: 1517 - DNA, 200 bp, Euphorbia heterophylla
gttggtatttgcacctgcagaagaatggatctcacgcacggacaccgagatcatagatgccactatgaaagaactcgcaaaactctttcccgatgaaatagctgcagaccaaagcaaagccaaaattctcaagtatcatgttgtaaagactccccggttagtctcctttgaaaaattgcatcgttgattagtatctcaca

SEQ ID NO: 1518 - DNA, 200 bp, Euphorbia heterophylla
tgtgagatactaatcaacgatgcaatttttcaaaggagactaaccggggagtctttacaacatgatacttgagaattttggctttgctttggtctgcagctatttcatcgggaaagagttttgcgagttctttcatagtggcatctatgatctcggtgtccgtgcgtgagatccattcttctgcaggtgcaaataccaac

SEQ ID NO: 1519 - DNA, 200 bp, Euphorbia heterophylla
ttgcatcgttgattagtatctcacatggttttgaaaaccagaccggactggccagttggaccaggtttgaccagaaccagccactggttcggtcggtgtttagtctaaatccggtcaaaaaccagttgtctgattataacttaaatccggttcgaccaccaacttaatttaattgaaccttaaacctatgaccggtctga

SEQ ID NO: 1520 - DNA, 200 bp, Euphorbia heterophylla
tcagaccggtcataggtttaaggttcaattaaattaagttggtggtcgaaccggatttaagttataatcagacaactggtttttgaccggatttagactaaacaccgaccgaaccagtggctggttctggtcaaacctggtccaactggccagtccggtctggttttcaaaaccatgtgagatactaatcaacgatgcaa

SEQ ID NO: 1521 - DNA, 200 bp, Euphorbia heterophylla
aaccttaaacctatgaccggtctgaaaggttcaaactaattgtagttgcgtaatgtttgttttacccatatttgtcaaaagtgtgcctcacgaagggcgcgacccttggcgcctcgccatactacaggcgaggtggtgttcctatggcgtacccctaaggcctaggggtgagcattccaataataccgaaccgaattacc

SEQ ID NO: 1522 - DNA, 200 bp, Euphorbia heterophylla
ggtaattcggttcggtattattggaatgctcacccctaggccttaggggtacgccataggaacaccacctcgcctgtagtatggcgaggcgccaagggtcgcgcccttcgtgaggcacacttttgacaaatatgggtaaaacaaacattacgcaactacaattagtttgaacctttcagaccggtcataggtttaaggtt

SEQ ID NO: 1523 - DNA, 200 bp, Euphorbia heterophylla
tccaataataccgaaccgaattaccaaattttcataaaattttttactgaaccgaatttcatgtgataccgaaatttccaaatgaaattatttcggttatccgaaaaattaaattaattaaaaaatgcaattgacttttcaataaaaaggttttcaaactcaaccagaaaatcttaattcatcgtattgtgaacaaaaca

SEQ ID NO: 1524 - DNA, 200 bp, Euphorbia heterophylla
tgttttgttcacaatacgatgaattaagattttctggttgagtttgaaaacctttttattgaaaagtcaattgcattttttaattaatttaatttttcggataaccgaaataatttcatttggaaatttcggtatcacatgaaattcggttcagtaaaaaattttatgaaaatttggtaattcggttcggtattattgga

SEQ ID NO: 1525 - DNA, 200 bp, Euphorbia heterophylla
aattcatcgtattgtgaacaaaacataacattagttatctaatagtaattcaaccatacatataaaacagataaaaatattatatggataaaccgaattatgaattttccgagccatactgaaccgaaatgtgaattatccgaaccgaattatgaaatatccgaaccgaaatccgaaatatccgaaccgaattcggttcg

SEQ ID NO: 1526 - DNA, 200 bp, Euphorbia heterophylla
cgaaccgaattcggttcggatatttcggatttcggttcggatatttcataattcggttcggataattcacatttcggttcagtatggctcggaaaattcataattcggtttatccatataatatttttatctgttttatatgtatggttgaattactattagataactaatgttatgttttgttcacaatacgatgaatt

SEQ ID NO: 1527 - DNA, 200 bp, Euphorbia heterophylla
aaatatccgaaccgaattcggttcggtaagttcggtaattcggataataccgaattctgcacaccgctacctaaggcccgcttcaggattttaacttactttaatatgtgttttccatttattttttaagagttctaataattcaaatatttatatctaacatttctcttctcttggttctttttgtggcactgttattg

SEQ ID NO: 1528 - DNA, 200 bp, Euphorbia heterophylla
caataacagtgccacaaaaagaaccaagagaagagaaatgttagatataaatatttgaattattagaactcttaaaaaataaatggaaaacacatattaaagtaagttaaaatcctgaagcgggccttaggtagcggtgtgcagaattcggtattatccgaattaccgaacttaccgaaccgaattcggttcggatattt

SEQ ID NO: 1529 - DNA, 200 bp, Euphorbia heterophylla
ggttctttttgtggcactgttattgcatttaaagtcacctatcaatcaaattattttttgcgcctagtgtacctggagtgcgccgtgcctggctcctttgcgcctctaacaactatggttttaccttcaggtcggtttacaagactatcccaaactgtgaaccatgccgccctttgcaaagatcacccgtggaggggttc

SEQ ID NO: 1530 - DNA, 200 bp, Euphorbia heterophylla
gaacccctccacgggtgatctttgcaaagggcggcatggttcacagtttgggatagtcttgtaaaccgacctgaaggtaaaaccatagttgttagaggcgcaaaggagccaggcacggcgcactccaggtacactaggcgcaaaaaataatttgattgataggtgactttaaatgcaataacagtgccacaaaaagaacc

SEQ ID NO: 1531 - DNA, 200 bp, Euphorbia heterophylla
gcaaagatcacccgtggaggggttctatttagccggtgactacacaaagcagaagtatttggcttcaatggagggtgctgtcctatctggcaagttttgcgctcaagccattgtacaggtacttgtttttcactttttcttgaaacgatttccgatttgtattaggatattatagtttctttttcttaaatgtcagccat

SEQ ID NO: 1532 - DNA, 200 bp, Euphorbia heterophylla
atggctgacatttaagaaaaagaaactataatatcctaatacaaatcggaaatcgtttcaagaaaaagtgaaaaacaagtacctgtacaatggcttgagcgcaaaacttgccagataggacagcaccctccattgaagccaaatacttctgctttgtgtagtcaccggctaaatagaacccctccacgggtgatctttgc

SEQ ID NO: 1533 - DNA, 200 bp, Euphorbia heterophylla
tttctttttcttaaatgtcagccatctagcttttatgcatagtcgatgatattttatatgacgcaggattatgagttgcttgctgctcgggagcagacaaaattggctgaggcaaccgttagttaacaatgtaaatactgtttaaggtatagagaaaatcatctgattagtgatcataatacacaattaaagctcaaaga

SEQ ID NO: 1534 - DNA, 200 bp, Euphorbia heterophylla
tctttgagctttaattgtgtattatgatcactaatcagatgattttctctataccttaaacagtatttacattgttaactaacggttgcctcagccaattttgtctgctcccgagcagcaagcaactcataatcctgcgtcatataaaatatcatcgactatgcataaaagctagatggctgacatttaagaaaaagaaa

SEQ ID NO: 1535 - DNA, 200 bp, Euphorbia heterophylla
ataatacacaattaaagctcaaagaaaccaattcttgtactaataccgttttggttgtataatcatatattttttgccagcatttgctgttttgtgcacatatttgggaacaaaattcagtgaaaccgtgccaatatgtatagggtcgtatacacctatttctcatttaacttccgaaaatttctaacgtgttttgcaag

SEQ ID NO: 1536 - DNA, 200 bp, Euphorbia heterophylla
cttgcaaaacacgttagaaattttcggaagttaaatgagaaataggtgtatacgaccctatacatattggcacggtttcactgaattttgttcccaaatatgtgcacaaaacagcaaatgctggcaaaaaatatatgattatacaaccaaaacggtattagtacaagaattggtttctttgagctttaattgtgtattat

SEQ ID NO: 1537 - DNA, 200 bp, Euphorbia heterophylla
tattggacttttgccagcaatgcttggtggacaggcatatgttgaggctcaagatggtttgagtgttcaagagtggatgagaaagcagggtgttcctgatcgagtcactaaagaggtgttcattgccatgtcaaaggcactaaactttattaaccctgatgagctttcaatgcaatgtatattgatagcattgaacagat

SEQ ID NO: 1538 - DNA, 200 bp, Euphorbia heterophylla
atctgttcaatgctatcaatatacattgcattgaaagctcatcagggttaataaagtttagtgcctttgacatggcaatgaacacctctttagtgactcgatcaggaacaccctgctttctcatccactcttgaacactcaaaccatcttgagcctcaacatatgcctgtccaccaagcattgctggcaaaagtccaata

SEQ ID NO: 1539 - DNA, 200 bp, Euphorbia heterophylla
tcaattttgtaaatattttggaaatattgtataattatgataaattcccttttatcttcaggtcggtttacaagactgtcccgaactgtgaaccatgccgccctttgcaaagatcacccgtggaggggttctatttagccggtgactacacaaagcagaagtatttggcttccatggagggtgctgttctatctggcaag

SEQ ID NO: 1540 - DNA, 200 bp, Euphorbia heterophylla
cttgccagatagaacagcaccctccatggaagccaaatacttctgctttgtgtagtcaccggctaaatagaacccctccacgggtgatctttgcaaagggcggcatggttcacagttcgggacagtcttgtaaaccgacctgaagataaaagggaatttatcataattatacaatatttccaaaatatttacaaaattga

SEQ ID NO: 1541 - DNA, 200 bp, Euphorbia heterophylla
ggagggtgctgttctatctggcaagttttgtgttcaagccattgtacaggtacttgtttttcttgaaacgacttccgatttgtattaggatattataatttctttttcttaaatgtcagccatctagcttttatgcatagtcaatgatattttatatgacgcaggattatgagttacttgcggctcgggagcagacaaaa

SEQ ID NO: 1542 - DNA, 200 bp, Euphorbia heterophylla
ttttgtctgctcccgagccgcaagtaactcataatcctgcgtcatataaaatatcattgactatgcataaaagctagatggctgacatttaagaaaaagaaattataatatcctaatacaaatcggaagtcgtttcaagaaaaacaagtacctgtacaatggcttgaacacaaaacttgccagatagaacagcaccctcc

SEQ ID NO: 1543 - DNA, 200 bp, Euphorbia heterophylla
acttgcggctcgggagcagacaaaattggctgaggcaaccgttagttaacaatgtaaatactgtttaaggtatagagaaaatcatctgattagtgatcataatacacaactaaagctcaaagaaaccaattcttgtactaataccgtttttggttgtataatcatatatttattaccagcatttgctattttgtgcacat

SEQ ID NO: 1544 - DNA, 200 bp, Euphorbia heterophylla
atgtgcacaaaatagcaaatgctggtaataaatatatgattatacaaccaaaaacggtattagtacaagaattggtttctttgagctttagttgtgtattatgatcactaatcagatgattttctctataccttaaacagtatttacattgttaactaacggttgcctcagccaattttgtctgctcccgagccgcaagt

SEQ ID NO: 1545 - DNA, 200 bp, Euphorbia heterophylla
ccagcatttgctattttgtgcacatatatgggaacgaaattcagtgaaaccgtgccaatatgtatagggtcgaatacacctatttctcattgaacttcccaaaatttctaaagtgttctgcaagaactataatttggttttaaatttctttaaagtcctattagtggttgaaactgaatatttgactctagattattgca

SEQ ID NO: 1546 - DNA, 200 bp, Euphorbia heterophylla
tgcaataatctagagtcaaatattcagtttcaaccactaataggactttaaagaaatttaaaaccaaattatagttcttgcagaacactttagaaattttgggaagttcaatgagaaataggtgtattcgaccctatacatattggcacggtttcactgaatttcgttcccatatatgtgcacaaaatagcaaatgctgg

SEQ ID NO: 1547 - DNA, 200 bp, Euphorbia heterophylla
tcttgcttatttcagttcagcactttttgaagtatgcttgcttcaattttgatttatgggtaggtagggactacaattatttgatttttattttagttttagcgtttaaacattttttctcggaagctgttgtccaagtcaataacttagcatattgttttggaataaaatctgcagacttttgtggttatttatgtacc

SEQ ID NO: 1548 - DNA, 200 bp, Euphorbia heterophylla
ggtacataaataaccacaaaagtctgcagattttattccaaaacaatatgctaagttattgacttggacaacagcttccgagaaaaaatgtttaaacgctaaaactaaaataaaaatcaaataattgtagtccctacctacccataaatcaaaattgaagcaagcatacttcaaaaagtgctgaactgaaataagcaaga

SEQ ID NO: 1549 - DNA, 200 bp, Euphorbia heterophylla
agacttttgtggttatttatgtacctttttttaatttggttacgatggattaacgccttttacatcatgctgcagggttggctggtttatcaacggcaaaatatttagcagatgcagggcacaagcctttattacttgaagcaagagatgttcttggaggaaaggttatgctttacctagacttcaagaaaattatgcat

SEQ ID NO: 1550 - DNA, 200 bp, Euphorbia heterophylla
atgcataattttcttgaagtctaggtaaagcataacctttcctccaagaacatctcttgcttcaagtaataaaggcttgtgccctgcatctgctaaatattttgccgttgataaaccagccaaccctgcagcatgatgtaaaaggcgttaatccatcgtaaccaaattaaaaaaaggtacataaataaccacaaaagtct

SEQ ID NO: 1551 - DNA, 200 bp, Euphorbia heterophylla
cctagacttcaagaaaattatgcattgagttaccaattattacacaatatgaataacaattggtgcaaacaaatgaattggattatagactctatttgtatgattatttttcatttagctaagactaatgcatgagagtataagagtttcatttgttaatgaatatctggcatgtgtcatttgaaatcaatgtcatcatc

SEQ ID NO: 1552 - DNA, 200 bp, Euphorbia heterophylla
gatgatgacattgatttcaaatgacacatgccagatattcattaacaaatgaaactcttatactctcatgcattagtcttagctaaatgaaaaataatcatacaaatagagtctataatccaattcatttgtttgcaccaattgttattcatattgtgtaataattggtaactcaatgcataattttcttgaagtctagg

SEQ ID NO: 1553 - DNA, 200 bp, Euphorbia heterophylla
gtcatttgaaatcaatgtcatcatcattattatgatttggctatctagtaggtgcctttggtgcacattcttccgccattgaaattatttagttgaccggcttctaattctcttgtttcgaattcattaccaaattttatttcttctctatccatccataatatagttttcctatatattagttacattcctccgtttct

SEQ ID NO: 1554 - DNA, 200 bp, Euphorbia heterophylla
agaaacggaggaatgtaactaatatataggaaaactatattatggatggatagagaagaaataaaatttggtaatgaattcgaaacaagagaattagaagccggtcaactaaataatttcaatggcggaagaatgtgcaccaaaggcacctactagatagccaaatcataataatgatgatgacattgatttcaaatgac

SEQ ID NO: 1555 - DNA, 200 bp, Euphorbia heterophylla
atattagttacattcctccgtttctattctattattagcaagccctgttgtcttgtatatgtctattcatatactagttttatttattggcattgctgctaaagtgctgttctgtacgggcatcactgacatttaatatgactagttgaagttcttcaatgccgcatcaatggttgaattccttcacagttcaagcaaat

SEQ ID NO: 1556 - DNA, 200 bp, Euphorbia heterophylla
atttgcttgaactgtgaaggaattcaaccattgatgcggcattgaagaacttcaactagtcatattaaatgtcagtgatgcccgtacagaacagcactttagcagcaatgccaataaataaaactagtatatgaatagacatatacaagacaacagggcttgctaataatagaatagaaacggaggaatgtaactaatat

SEQ ID NO: 1557 - DNA, 200 bp, Euphorbia heterophylla
gaattccttcacagttcaagcaaatggtcaaaccaattgactttctctaagaaaaaagtttttcttttttttaacttgaaaggttataatctctttcctgttattatgtgctccaggctcatagttgttttctttaaataggtggctgcatggaaagataaagatggggactggtatgagacaggcttgcatatattctg

SEQ ID NO: 1558 - DNA, 200 bp, Euphorbia heterophylla
cagaatatatgcaagcctgtctcataccagtccccatctttatctttccatgcagccacctatttaaagaaaacaactatgagcctggagcacataataacaggaaagagattataacctttcaagttaaaaaaaagaaaaacttttttcttagagaaagtcaattggtttgaccatttgcttgaactgtgaaggaattc

SEQ ID NO: 1559 - DNA, 200 bp, Euphorbia heterophylla
atgagacaggcttgcatatattctgtaagtttcagaaccctttaggaatgagtcattgtaatgccacttccattctcgttgtgtatttgtatgttaattttacttgtcaccatttttgtgaaatcactttcataatttcccacagtgaattaatttttttttaaatattcttttggttgttgtgaacaggcattgctaat

SEQ ID NO: 1560 - DNA, 200 bp, Euphorbia heterophylla
attagcaatgcctgttcacaacaaccaaaagaatatttaaaaaaaaattaattcactgtgggaaattatgaaagtgatttcacaaaaatggtgacaagtaaaattaacatacaaatacacaacgagaatggaagtggcattacaatgactcattcctaaagggttctgaaacttacagaatatatgcaagcctgtctcat

SEQ ID NO: 1561 - DNA, 200 bp, Euphorbia heterophylla
gttgttgtgaacaggcattgctaatttgatgctggatgtagtttttccttttccttattagtttcagatgcttaaacttttgtggtttattgctttacttattgaacctgtcttctttggtttacaagttggagcatatccaaatgtgcagaacctgtttggagaactaaacatcaatgataggctgcagtggaaggagc

SEQ ID NO: 1562 - DNA, 200 bp, Euphorbia heterophylla
gctccttccactgcagcctatcattgatgtttagttctccaaacaggttctgcacatttggatatgctccaacttgtaaaccaaagaagacaggttcaataagtaaagcaataaaccacaaaagtttaagcatctgaaactaataaggaaaaggaaaaactacatccagcatcaaattagcaatgcctgttcacaacaac

SEQ ID NO: 1563 - DNA, 200 bp, Euphorbia heterophylla
aatgataggctgcagtggaaggagcattctatgatatttgcaatgccaagcaagccaggggagttcagtcgatttgactttcctgatgttcttccagcacctttaaatggtatacaatttaaacacttcctgaaaattgatttttcatgtgcaacttttaggagctagcgagacctataaaaattgtctgtaagcataga

SEQ ID NO: 1564 - DNA, 200 bp, Euphorbia heterophylla
tctatgcttacagacaatttttataggtctcgctagctcctaaaagttgcacatgaaaaatcaattttcaggaagtgtttaaattgtataccatttaaaggtgctggaagaacatcaggaaagtcaaatcgactgaactcccctggcttgcttggcattgcaaatatcatagaatgctccttccactgcagcctatcatt

SEQ ID NO: 1565 - DNA, 200 bp, Euphorbia heterophylla
tataaaaattgtctgtaagcatagatattgtatattggcttaattttatgaatgaaaacaattgtcttttagttgaaaaccggtttaaattcttatcatgtaatctcttatatttcgttgattttttttgtaattttcatatttctgctcacattgttgatgttttgctaagcacccctttgttttctcggcactcacct

SEQ ID NO: 1566 - DNA, 200 bp, Euphorbia heterophylla
aggtgagtgccgagaaaacaaaggggtgcttagcaaaacatcaacaatgtgagcagaaatatgaaaattacaaaaaaaatcaacgaaatataagagattacatgataagaatttaaaccggttttcaactaaaagacaattgttttcattcataaaattaagccaatatacaatatctatgcttacagacaatttttata

SEQ ID NO: 1567 - DNA, 200 bp, Euphorbia heterophylla
ccctttgttttctcggcactcacctctttctgattgttgtcttctacttgagacaactcttgttgcagacatatccatatatttgtatatcagccaaacatatacgttaattgtatgatttgtaattgattctgtttaggcttcaagggatagctaataaagggcacatttctctgttctcttgtggattttattattgt

SEQ ID NO: 1568 - DNA, 200 bp, Euphorbia heterophylla
acaataataaaatccacaagagaacagagaaatgtgccctttattagctatcccttgaagcctaaacagaatcaattacaaatcatacaattaacgtatatgtttggctgatatacaaatatatggatatgtctgcaacaagagttgtctcaagtagaagacaacaatcagaaagaggtgagtgccgagaaaacaaaggg

SEQ ID NO: 1569 - DNA, 200 bp, Euphorbia heterophylla
gttctcttgtggattttattattgtgatataggatataactagaggagtagaggttgtcatataacaataccaccttcgcaaatacatgctttgtagcaatggagaagtttagaatgctgagttaaaccgtattttggccttcagaagtacccaagatttacaatatgcgtattaactaatgataaatggaaagcaattt

SEQ ID NO: 1570 - DNA, 200 bp, Euphorbia heterophylla
aaattgctttccatttatcattagttaatacgcatattgtaaatcttgggtacttctgaaggccaaaatacggtttaactcagcattctaaacttctccattgctacaaagcatgtatttgcgaaggtggtattgttatatgacaacctctactcctctagttatatcctatatcacaataataaaatccacaagagaac

SEQ ID NO: 1571 - DNA, 200 bp, Euphorbia heterophylla
actaatgataaatggaaagcaatttcccaatgtatatatcttaaataattgctctatatcttctatttttttttttttgtaatcttacaattttctgtcatttctaaaattttttatggtcatttaacttatttatctatataactattgtttttttcaaattttcttagtttattgcatacttcggtattgcctacaaa

SEQ ID NO: 1572 - DNA, 200 bp, Euphorbia heterophylla
tttgtaggcaataccgaagtatgcaataaactaagaaaatttgaaaaaaacaatagttatatagataaataagttaaatgaccataaaaaattttagaaatgacagaaaattgtaagattacaaaaaaaaaaaaatagaagatatagagcaattatttaagatatatacattgggaaattgctttccatttatcattagt

SEQ ID NO: 1573 - DNA, 200 bp, Euphorbia heterophylla
tgcatacttcggtattgcctacaaaatattgtttaaaagtaatgtatattttctatggttgtgcttgacagggatatgggccattttaaaaaacaatgagatgctgacttggccggagaaagtgaaatttgctattggacttttgccagcaatgctcggtggacaggcatatgttgaggctcaagatggtttgagtgttc

SEQ ID NO: 1574 - DNA, 200 bp, Euphorbia heterophylla
gaacactcaaaccatcttgagcctcaacatatgcctgtccaccgagcattgctggcaaaagtccaatagcaaatttcactttctccggccaagtcagcatctcattgttttttaaaatggcccatatccctgtcaagcacaaccatagaaaatatacattacttttaaacaatattttgtaggcaataccgaagtatgca

SEQ ID NO: 1575 - DNA, 200 bp, Euphorbia heterophylla
gaggctcaagatggtttgagtgttcaagagtggatgagaaagcaggtacttttgatagatcaaatcaataagaataacacatggcttcttataggcataactctccagccaagggtcctggagtcgcattgatcatcgtgcaatttaaacagaagaaaccaatactgaactaaaatactcaacattgctcgattaaaaat

SEQ ID NO: 1576 - DNA, 200 bp, Euphorbia heterophylla
atttttaatcgagcaatgttgagtattttagttcagtattggtttcttctgtttaaattgcacgatgatcaatgcgactccaggacccttggctggagagttatgcctataagaagccatgtgttattcttattgatttgatctatcaaaagtacctgctttctcatccactcttgaacactcaaaccatcttgagcctc

SEQ ID NO: 1577 - DNA, 200 bp, Euphorbia heterophylla
tactcaacattgctcgattaaaaattgatttattttctgaaactagtaaaatctataaatgtatcaagtataacaaataaactctgtttttggtatattttttttgtaattttccctgttcgattgtcagggtgttcctgatcgagtcactaaagaggtattcattgccatgtcaaaggcactaaactttataaaccctg

SEQ ID NO: 1578 - DNA, 200 bp, Euphorbia heterophylla
cagggtttataaagtttagtgcctttgacatggcaatgaatacctctttagtgactcgatcaggaacaccctgacaatcgaacagggaaaattacaaaaaaaatataccaaaaacagagtttatttgttatacttgatacatttatagattttactagtttcagaaaataaatcaatttttaatcgagcaatgttgagta

SEQ ID NO: 1579 - DNA, 200 bp, Euphorbia heterophylla
aaggcactaaactttataaaccctgatgagctttcaatgcaatgtatattgatagcattgaatagatttcttcaggtatgattctttttctttctctttctattcctcgatgagctttccattaatattttttgaatgaaggtttgtttaacaactttcatgtgtttagctggctgaaaagaagttttgcttttcctttt

SEQ ID NO: 1580 - DNA, 200 bp, Euphorbia heterophylla
aaaaggaaaagcaaaacttcttttcagccagctaaacacatgaaagttgttaaacaaaccttcattcaaaaaatattaatggaaagctcatcgaggaatagaaagagaaagaaaaagaatcatacctgaagaaatctattcaatgctatcaatatacattgcattgaaagctcatcagggtttataaagtttagtgcctt

SEQ ID NO: 1581 - DNA, 200 bp, Euphorbia heterophylla
gaaaagaagttttgcttttccttttcctttaaataaacgaaattgaaattttcttttacattttcttggttactcttgaagatgttattgttgaatgattgcacataagccttgaatatactcattacaaattttttatacttttgtcattttttctcttttttctaaaagtttctcaatattatctttaccacttcaca

SEQ ID NO: 1582 - DNA, 200 bp, Euphorbia heterophylla
tgtgaagtggtaaagataatattgagaaacttttagaaaaaagagaaaaaatgacaaaagtataaaaaatttgtaatgagtatattcaaggcttatgtgcaatcattcaacaataacatcttcaagagtaaccaagaaaatgtaaaagaaaatttcaatttcgtttatttaaaggaaaaggaaaagcaaaacttcttttc

SEQ ID NO: 1583 - DNA, 200 bp, Euphorbia heterophylla
tcaatattatctttaccacttcacataagatctgtggaagtttcttatataatgaaactaactgaataacgatcaatggcaatatcaacaggaaaagcatggttctaagatggctttcttagatggaaatcccccagagaggctttgcatgccaattgttgaacacattcagtccttaggtggtgaagtacgactaaatt

SEQ ID NO: 1584 - DNA, 200 bp, Euphorbia heterophylla
aatttagtcgtacttcaccacctaaggactgaatgtgttcaacaattggcatgcaaagcctctctgggggatttccatctaagaaagccatcttagaaccatgcttttcctgttgatattgccattgatcgttattcagttagtttcattatataagaaacttccacagatcttatgtgaagtggtaaagataatattga

SEQ ID NO: 1585 - DNA, 200 bp, Euphorbia heterophylla
ttgccggtccaggtaaacttgaaattttggataacaaataattctattatttttgtgatccagtgtttctaatactagtatattttcttttatcattagttgatatattgaagcttcttttgcctgataactggaaagagattccttacttcaagaaattggataaattagttggagttcctgtcattaatgttcatatt

SEQ ID NO: 1586 - DNA, 200 bp, Euphorbia heterophylla
aatatgaacattaatgacaggaactccaactaatttatccaatttcttgaagtaaggaatctctttccagttatcaggcaaaagaagcttcaatatatcaactaatgataaaagaaaatatactagtattagaaacactggatcacaaaaataatagaattatttgttatccaaaatttcaagtttacctggaccggcaa

SEQ ID NO: 1587 - DNA, 200 bp, Euphorbia heterophylla
agttcctgtcattaatgttcatatttggtcagtgatgaattcttttatctagtgactgtttatgtgagagttcaaatatcagcacatgattcactaaaataaatctatttctttttcaggtttgatcggaaactaaagaatacatacgatcatctgcttttcagcaggtcctgctcttacgcttttctctagctgttctt

SEQ ID NO: 1588 - DNA, 200 bp, Euphorbia heterophylla
aagaacagctagagaaaagcgtaagagcaggacctgctgaaaagcagatgatcgtatgtattctttagtttccgatcaaacctgaaaaagaaatagatttattttagtgaatcatgtgctgatatttgaactctcacataaacagtcactagataaaagaattcatcactgaccaaatatgaacattaatgacaggaact

SEQ ID NO: 1589 - DNA, 200 bp, Euphorbia heterophylla
cttacgcttttctctagctgttcttcacccatagagatttctacaatcatttttgtaacttttttaaaagctgttatattctgaagggttctgttaggggtacgaaaaccttctttcatgaaggaaatcaattcattacaaatcattttatgtataaattgatttgaatcttgtatgtaaaatgatttcaaatgaattta

SEQ ID NO: 1590 - DNA, 200 bp, Euphorbia heterophylla
taaattcatttgaaatcattttacatacaagattcaaatcaatttatacataaaatgatttgtaatgaattgatttccttcatgaaagaaggttttcgtacccctaacagaacccttcagaatataacagcttttaaaaaagttacaaaaatgattgtagaaatctctatgggtgaagaacagctagagaaaagcgtaag

SEQ ID NO: 1591 - DNA, 200 bp, Euphorbia heterophylla
ttgtgttagatgggctcaaccctacttgtatgctcactcgtcctatcgagcccaacactctccaggcccacggattctctacaggttcaaacaatagtaacgtcacttatcaagcaaattaatttttgcgcctagtgtacctcaagtgcacgctgggcctggcccctttgcatctccaacaactatggttataccttgcg

SEQ ID NO: 1592 - DNA, 200 bp, Euphorbia heterophylla
cgcaaggtataaccatagttgttggagatgcaaaggggccaggcccagcgtgcacttgaggtacactaggcgcaaaaattaatttgcttgataagtgacgttactattgtttgaacctgtagagaatccgtgggcctggagagtgttgggctcgataggacgagtgagcatacaagtagggttgagcccatctaacacaa

SEQ ID NO: 1593 - DNA, 200 bp, Euphorbia heterophylla
ccaacaactatggttataccttgcggttttcataaaaagcctcaaaatataatttcagctcataccagaaaatatttacaagtttacaaaaataggggtaaaatattgacaaaaatacagtccgctatttttcatatagttttcatctggtgtgctagttttcatatagtttccatatagttttcattaggttttcatcc

SEQ ID NO: 1594 - DNA, 200 bp, Euphorbia heterophylla
ggatgaaaacctaatgaaaactatatggaaactatatgaaaactagcacaccagatgaaaactatatgaaaaatagcggactgtatttttgtcaatattttacccctatttttgtaaacttgtaaatattttctggtatgagctgaaattatattttgaggctttttatgaaaaccgcaaggtataaccatagttgttgg

SEQ ID NO: 1595 - DNA, 200 bp, Euphorbia heterophylla
tttttttgttgtggtaaaatttcccagccctctttctatagggaagttgaacgggattatttttttttttaccgaagaatcaacatgaaatatctccgattttttctttcaaacgatatttatttgttcaatcacttgttttagctcaacattttctcccacttttgtaatattaagcttattttacatttatcaatcaa

SEQ ID NO: 1596 - DNA, 200 bp, Euphorbia heterophylla
ttgattgataaatgtaaaataagcttaatattacaaaagtgggagaaaatgttgagctaaaacaagtgattgaacaaataaatatcgtttgaaagaaaaaatcggagatatttcatgttgattcttcggtaaaaaaaaaaataatcccgttcaacttccctatagaaagagggctgggaaattttaccacaacaaaaaaa

SEQ ID NO: 1597 - DNA, 200 bp, Kochia scoparia
aatgcttaaacaattaaaattaacataatttgtaggtgaggcatgctaggtttgatcaaatttagacatgagtgacgaattgagtcttgcctaataggatcaaactcatgatatgacatgcactatggattattttgcatgagatttttataaaacttgatataatctacctaactaatgtatgtcctgattgacatttg

SEQ ID NO: 1598 - DNA, 200 bp, Kochia scoparia
caaatgtcaatcaggacatacattagttaggtagattatatcaagttttataaaaatctcatgcaaaataatccatagtgcatgtcatatcatgagtttgatcctattaggcaagactcaattcgtcactcatgtctaaatttgatcaaacctagcatgcctcacctacaaattatgttaattttaattgtttaagcatt

SEQ ID NO: 1599 - DNA, 200 bp, Kochia scoparia
taatgtatgtcctgattgacatttgagttgtccaacaacgtgccacgacatcaattcaagagttcttcgaagaaaataagtaaataaccccaatctcaaggataaggagatttgaagggtaaaaaaacttgatctacccattgagtagactacccaccattaattgacagggtagaaagtggaaaattcctagtcaatcc

SEQ ID NO: 1600 - DNA, 200 bp, Kochia scoparia
ggattgactaggaattttccactttctaccctgtcaattaatggtgggtagtctactcaatgggtagatcaagtttttttacccttcaaatctccttatccttgagattggggttatttacttattttcttcgaagaactcttgaattgatgtcgtggcacgttgttggacaactcaaatgtcaatcaggacatacatta

SEQ ID NO: 1601 - DNA, 200 bp, Kochia scoparia
aaagtggaaaattcctagtcaatccaatggattgataatccaatggcattttggtaaataaatggaaaaaaagaaaaaaataaatggcaatgttgtaaataaaatatttcatttatttactaaaataccattgaattgacaatttttgtcaatccattggatggactaggcatccctcgtagaaagtggtgacaatagaa

SEQ ID NO: 1602 - DNA, 200 bp, Kochia scoparia
ttctattgtcaccactttctacgagggatgcctagtccatccaatggattgacaaaaattgtcaattcaatggtattttagtaaataaatgaaatattttatttacaacattgccatttatttttttctttttttccatttatttaccaaaatgccattggattatcaatccattggattgactaggaattttccacttt

SEQ ID NO: 1603 - DNA, 200 bp, Kochia scoparia
ctcgtagaaagtggtgacaatagaatttcactcaagttataaacaatagatatgtgtatgcgatccattaggtaaatgtaatcatgtccgagccgaagggatcaagcctagacactagtcaagcttgggttggtaaaatggtaaacacttcgtatgtattgaagtattgtaagtacatgaataaccgtaaaggctctaaa

SEQ ID NO: 1604 - DNA, 200 bp, Kochia scoparia
tttagagcctttacggttattcatgtacttacaatacttcaatacatacgaagtgtttaccattttaccaacccaagcttgactagtgtctaggcttgatcccttcggctcggacatgattacatttacctaatggatcgcatacacatatctattgtttataacttgagtgaaattctattgtcaccactttctacgag

SEQ ID NO: 1605 - DNA, 200 bp, Kochia scoparia
catgaataaccgtaaaggctctaaagctactactactactaattgggtaaccgcaatatgtgtggacagttcgaaagccacacaatttgagtggcattttccatttttcaattctctctctctctcagtggctcaaacagaaatcgcattacacccacattccacaaatggccctttgataaagcactaaacctactcta

SEQ ID NO: 1606 - DNA, 200 bp, Kochia scoparia
tagagtaggtttagtgctttatcaaagggccatttgtggaatgtgggtgtaatgcgatttctgtttgagccactgagagagagagagaattgaaaaatggaaaatgccactcaaattgtgtggctttcgaactgtccacacatattgcggttacccaattagtagtagtagtagctttagagcctttacggttattcatg

SEQ ID NO: 1607 - DNA, 200 bp, Kochia scoparia
ttgataaagcactaaacctactctactcctacactccttcatctaatctcaatttccgttacttctttggttctattgcacacccttttacacccattgcagtttatattccactgaatttcgtattgcaaacccaatttacaaaaattgcagaagaaaatgagtcattttggatatgcttgtgctacccaatccacttc

SEQ ID NO: 1608 - DNA, 200 bp, Kochia scoparia
gaagtggattgggtagcacaagcatatccaaaatgactcattttcttctgcaatttttgtaaattgggtttgcaatacgaaattcagtggaatataaactgcaatgggtgtaaaagggtgtgcaatagaaccaaagaagtaacggaaattgagattagatgaaggagtgtaggagtagagtaggtttagtgctttatcaa

SEQ ID NO: 1609 - DNA, 200 bp, Kochia scoparia
atgcttgtgctacccaatccacttcaagatgtgttcttttgggcaattctggtaaccccacttcagtttcatctcgtggcagtgatttcatgggtcattctgtaagaaatttcagttttagcaaaagacagagaattgggcactgcccattgaaggttctattgcttgctttcttgtttatggatcaattttgtgggatt

SEQ ID NO: 1610 - DNA, 200 bp, Kochia scoparia
aatcccacaaaattgatccataaacaagaaagcaagcaatagaaccttcaatgggcagtgcccaattctctgtcttttgctaaaactgaaatttcttacagaatgacccatgaaatcactgccacgagatgaaactgaagtggggttaccagaattgcccaaaagaacacatcttgaagtggattgggtagcacaagcat

SEQ ID NO: 1611 - DNA, 200 bp, Kochia scoparia
gtttatggatcaattttgtgggatttgatgaaaagattagattttgtttatagttgaattaatcgagaattttaatgtatgatgcaggttgtttgtgtagattatccaagaccagagcttgaaggtacagtcaattacttggaagctgcttatttatcttcaacttttcggaattcacctcgtcctcaaaagccgttaga

SEQ ID NO: 1612 - DNA, 200 bp, Kochia scoparia
tctaacggcttttgaggacgaggtgaattccgaaaagttgaagataaataagcagcttccaagtaattgactgtaccttcaagctctggtcttggataatctacacaaacaacctgcatcatacattaaaattctcgattaattcaactataaacaaaatctaatcttttcatcaaatcccacaaaattgatccataaac

SEQ ID NO: 1613 - DNA, 200 bp, Kochia scoparia
cacctcgtcctcaaaagccgttagaggttgtaattgccggtgcaggtaagtgggatgtttcctgtaacttgctttgttcattagtttcttgttcttttgcttgttgctttataaactagtgatgtttggtatgtgtttggtgtaatcattgtcttactgatatggaaaggattatgtaggagggaaaagggtagtgataa

SEQ ID NO: 1614 - DNA, 200 bp, Kochia scoparia
ttatcactacccttttccctcctacataatcctttccatatcagtaagacaatgattacaccaaacacataccaaacatcactagtttataaagcaacaagcaaaagaacaagaaactaatgaacaaagcaagttacaggaaacatcccacttacctgcaccggcaattacaacctctaacggcttttgaggacgaggtg

SEQ ID NO: 1615 - DNA, 200 bp, Kochia scoparia
gtaggagggaaaagggtagtgataattactgggtgtttggctaaggatgttcagcatagcatggttgtctcttacaaccacactcatgtattaccatggtaagggttgtacttagaaaattgttgtatttggcaattggcaatacaatggaattgaaccatatttcatgaaggaccccctttggagagggtaaggtggtt

SEQ ID NO: 1616 - DNA, 200 bp, Kochia scoparia
aaccaccttaccctctccaaagggggtccttcatgaaatatggttcaattccattgtattgccaattgccaaatacaacaattttctaagtacaacccttaccatggtaatacatgagtgtggttgtaagagacaaccatgctatgctgaacatccttagccaaacacccagtaattatcactacccttttccctcctac

SEQ ID NO: 1617 - DNA, 200 bp, Kochia scoparia
cccctttggagagggtaaggtggttttaattgtatccataggttttcaaagggtgacaagtggagggaaatggttaccttcaggaaatgaggtttgttcctacacttacaccaaatggtgtgcaattacaccttaaaatccattaccaaacacccttaggtttcggtttatcatctgttagaggcctaccaatgagaatt

SEQ ID NO: 1618 - DNA, 200 bp, Kochia scoparia
aattctcattggtaggcctctaacagatgataaaccgaaacctaagggtgtttggtaatggattttaaggtgtaattgcacaccatttggtgtaagtgtaggaacaaacctcatttcctgaaggtaaccatttccctccacttgtcaccctttgaaaacctatggatacaattaaaaccaccttaccctctccaaagggg

SEQ ID NO: 1619 - DNA, 200 bp, Kochia scoparia
tgttagaggcctaccaatgagaatttcccttacgttaatgaagtaatgggttttgacaccttttttttttatgttgcatgttcgaaataagctttgtagtttgaagtagcttacggctaatagctgttatgcgggaatattgtgaattggaaaaagaataagagagtacttgcttcaaggatcataaggtttatgattgt

SEQ ID NO: 1620 - DNA, 200 bp, Kochia scoparia
acaatcataaaccttatgatccttgaagcaagtactctcttattctttttccaattcacaatattcccgcataacagctattagccgtaagctacttcaaactacaaagcttatttcgaacatgcaacataaaaaaaaaaggtgtcaaaacccattacttcattaacgtaagggaaattctcattggtaggcctctaaca

SEQ ID NO: 1621 - DNA, 200 bp, Kochia scoparia
caaggatcataaggtttatgattgttggaatcatctttagtgaaattttgattttcaactgatctctacggtaactattggtccttcaaaattctagacgcagaatcgtttaggtgagggtgaactctgattatgaatagtcaatgtctctcccaacgtgaaacttattagttctagctgttatgtgctccaattcgagg

SEQ ID NO: 1622 - DNA, 200 bp, Kochia scoparia
cctcgaattggagcacataacagctagaactaataagtttcacgttgggagagacattgactattcataatcagagttcaccctcacctaaacgattctgcgtctagaattttgaaggaccaatagttaccgtagagatcagttgaaaatcaaaatttcactaaagatgattccaacaatcataaaccttatgatccttg

SEQ ID NO: 1623 - DNA, 200 bp, Kochia scoparia
agctgttatgtgctccaattcgaggaacatcgtgaattggagaaagaatactgcttcaaggatcatgagtttatgattgtcgtaaacttctcttagttctttagtgaaatttcagcagattttaatggtaattagcagtccttcaaaatcctagatgcggaatcatctagggcatgtatatggtaaactctcatgataga

SEQ ID NO: 1624 - DNA, 200 bp, Kochia scoparia
tctatcatgagagtttaccatatacatgccctagatgattccgcatctaggattttgaaggactgctaattaccattaaaatctgctgaaatttcactaaagaactaagagaagtttacgacaatcataaactcatgatccttgaagcagtattctttctccaattcacgatgttcctcgaattggagcacataacagct

SEQ ID NO: 1625 - DNA, 200 bp, Kochia scoparia
gtatatggtaaactctcatgatagataactagtgtctcctccatgtaaactttattaggtattttctttgtcaaaaagagtatttttcattggaaaaacaatataatggtgactactgcatatgtttggttagctattcctgttgcaaatcagattttgaatggaacatgtcttattcccttctagagctctcctggtgc

SEQ ID NO: 1626 - DNA, 200 bp, Kochia scoparia
gcaccaggagagctctagaagggaataagacatgttccattcaaaatctgatttgcaacaggaatagctaaccaaacatatgcagtagtcaccattatattgtttttccaatgaaaaatactctttttgacaaagaaaatacctaataaagtttacatggaggagacactagttatctatcatgagagtttaccatatac

SEQ ID NO: 1627 - DNA, 200 bp, Kochia scoparia
ttcccttctagagctctcctggtgcaattctagcattttcccctcaataagtggtatttgagctaatatttcaagtctagacattatagcatgctataatgaggcggaattgtttgagccatgttaaagggttccatgacatgtaatatgctagtttatggcagggaacagggagttgggtccttgccttcatgggaaaa

SEQ ID NO: 1628 - DNA, 200 bp, Kochia scoparia
ttttcccatgaaggcaaggacccaactccctgttccctgccataaactagcatattacatgtcatggaaccctttaacatggctcaaacaattccgcctcattatagcatgctataatgtctagacttgaaatattagctcaaataccacttattgaggggaaaatgctagaattgcaccaggagagctctagaagggaa

SEQ ID NO: 1629 - DNA, 200 bp, Kochia scoparia
ttgggtccttgccttcatgggaaaagagagattgttaggtatttcttaagtttgcatgggaaagagttcttttatctttatagtgaaagttgactagtatgcaagtatggtggtggattacccttattgccatttggacttgtatgctatttagtgcatatacttcagcctagcttaatcttgacaaaaatgccttgagt

SEQ ID NO: 1630 - DNA, 200 bp, Kochia scoparia
actcaaggcatttttgtcaagattaagctaggctgaagtatatgcactaaatagcatacaagtccaaatggcaataagggtaatccaccaccatacttgcatactagtcaactttcactataaagataaaagaactctttcccatgcaaacttaagaaatacctaacaatctctcttttcccatgaaggcaaggacccaa

SEQ ID NO: 1631 - DNA, 200 bp, Kochia scoparia
taatcttgacaaaaatgccttgagttctagtggtttgctttattcattggttgatttgctatttctgctagtgaaattagagagaaaattgatgcctgtttcagtgtttctcatcaaggtaaatggacaaaactgtctatgtcttgaaattttctgtgaatactcaagcaggcttccttggtttgcttcaggctgatttt

SEQ ID NO: 1632 - DNA, 200 bp, Kochia scoparia
aaaatcagcctgaagcaaaccaaggaagcctgcttgagtattcacagaaaatttcaagacatagacagttttgtccatttaccttgatgagaaacactgaaacaggcatcaattttctctctaatttcactagcagaaatagcaaatcaaccaatgaataaagcaaaccactagaactcaaggcatttttgtcaagatta

SEQ ID NO: 1633 - DNA, 200 bp, Kochia scoparia
ccttggtttgcttcaggctgattttcattgcctcagtttctgcttgttggtatcagaataaaaatagatacttttatgtatttgtgagagatttgttggtagaaccacatttattctgagaaatatttgtacaaatgggagtttaaggttataagtgtgtaagccttttgaggtattttgttttaaaaatcttatcgtta

SEQ ID NO: 1634 - DNA, 200 bp, Kochia scoparia
taacgataagatttttaaaacaaaatacctcaaaaggcttacacacttataaccttaaactcccatttgtacaaatatttctcagaataaatgtggttctaccaacaaatctctcacaaatacataaaagtatctatttttattctgataccaacaagcagaaactgaggcaatgaaaatcagcctgaagcaaaccaagg

SEQ ID NO: 1635 - DNA, 200 bp, Kochia scoparia
ttttgttttaaaaatcttatcgttatttcagagcagcaagttacatatagtaaacttgggagcattggagatgtgatggaattagattcaatatattttatcatcaagatatgagttctaattcaaaactttccttctaggtttggctggtctatccacagcgaagtacttggcagatgcaggacacaaacccatattgc

SEQ ID NO: 1636 - DNA, 200 bp, Kochia scoparia
gcaatatgggtttgtgtcctgcatctgccaagtacttcgctgtggatagaccagccaaacctagaaggaaagttttgaattagaactcatatcttgatgataaaatatattgaatctaattccatcacatctccaatgctcccaagtttactatatgtaacttgctgctctgaaataacgataagatttttaaaacaaaa

SEQ ID NO: 1637 - DNA, 200 bp, Kochia scoparia
gatgcaggacacaaacccatattgcttgaggcacgagatgttttgggtggaaaggtatgtgcttatatgctattttttcagaaatatatcctttgtgcttcttctcttctcagtttatgttgactataataaatgaaacagcttaattgtcttggttgtatgctttcatagtattatctaggctacatggttatacggac

SEQ ID NO: 1638 - DNA, 200 bp, Kochia scoparia
gtccgtataaccatgtagcctagataatactatgaaagcatacaaccaagacaattaagctgtttcatttattatagtcaacataaactgagaagagaagaagcacaaaggatatatttctgaaaaaatagcatataagcacatacctttccacccaaaacatctcgtgcctcaagcaatatgggtttgtgtcctgcatc

SEQ ID NO: 1639 - DNA, 200 bp, Kochia scoparia
atctaggctacatggttatacggacatatattattgagtggagtgatttagtcatcttaagtggttatttacttttattttatagctgttgaagttattcatcattctgtacaatgttaagtcagtgttaatgaggtttagagggtaatggactaatagacaagctttgtgctgtgaacggtttgagaacatgtgctatt

SEQ ID NO: 1640 - DNA, 200 bp, Kochia scoparia
aatagcacatgttctcaaaccgttcacagcacaaagcttgtctattagtccattaccctctaaacctcattaacactgacttaacattgtacagaatgatgaataacttcaacagctataaaataaaagtaaataaccacttaagatgactaaatcactccactcaataatatatgtccgtataaccatgtagcctagat

SEQ ID NO: 1641 - DNA, 200 bp, Kochia scoparia
gaacggtttgagaacatgtgctattgggactgatgttatgcaatgtttgtggtagtcttccttcttatgcatttgtttattgttactgtttcacaggttgcagcgtggaaagatgaggatggtgactggtatgaaactgggctccatatattctgtgagtataatattttgcttttcagcttagatatcctgtttaagct

SEQ ID NO: 1642 - DNA, 200 bp, Kochia scoparia
agcttaaacaggatatctaagctgaaaagcaaaatattatactcacagaatatatggagcccagtttcataccagtcaccatcctcatctttccacgctgcaacctgtgaaacagtaacaataaacaaatgcataagaaggaagactaccacaaacattgcataacatcagtcccaatagcacatgttctcaaaccgttc

SEQ ID NO: 1643 - DNA, 200 bp, Kochia scoparia
tcagcttagatatcctgtttaagcttctagtcctacaatttatgttttctgctgagtggatttttgtaaaagttttacgggatctgtgcaatttctgccttctgattctgttattatttggaagggcgtgatattgtgacaatttcaaagtggtttcactccagacaaaagtcaaactaacaattcaatgtactgaatac

SEQ ID NO: 1644 - DNA, 200 bp, Kochia scoparia
gtattcagtacattgaattgttagtttgacttttgtctggagtgaaaccactttgaaattgtcacaatatcacgcccttccaaataataacagaatcagaaggcagaaattgcacagatcccgtaaaacttttacaaaaatccactcagcagaaaacataaattgtaggactagaagcttaaacaggatatctaagctga

SEQ ID NO: 1645 - DNA, 200 bp, Kochia scoparia
actaacaattcaatgtactgaatacccttttattttcttgaagttggggcttatccaaatgtgcagaacttgtttggagaacttggtatcaatgaccgattgcaatggaaggaacattctatgatttttgcaaggcctgacaaaccgggtgaatttagccgctttgattttcctgaagccctgcctgcacctttaaatgg

SEQ ID NO: 1646 - DNA, 200 bp, Kochia scoparia
ccatttaaaggtgcaggcagggcttcaggaaaatcaaagcggctaaattcacccggtttgtcaggccttgcaaaaatcatagaatgttccttccattgcaatcggtcattgataccaagttctccaaacaagttctgcacatttggataagccccaacttcaagaaaataaaagggtattcagtacattgaattgttagt

SEQ ID NO: 1647 - DNA, 200 bp, Kochia scoparia
aagccctgcctgcacctttaaatggtgagtatttgacaccttatattctttagcaaactaagtattgtataagccaaactgcacctggtgacattcattgatttctttcttgctcaccgactttccttgagattctagcaacatcttattctccgtcttctaatgagtaaactagttttgattctgttcattcttaatgt

SEQ ID NO: 1648 - DNA, 200 bp, Kochia scoparia
acattaagaatgaacagaatcaaaactagtttactcattagaagacggagaataagatgttgctagaatctcaaggaaagtcggtgagcaagaaagaaatcaatgaatgtcaccaggtgcagtttggcttatacaatacttagtttgctaaagaatataaggtgtcaaatactcaccatttaaaggtgcaggcagggctt

SEQ ID NO: 1649 - DNA, 200 bp, Kochia scoparia
ttttgattctgttcattcttaatgtgtttggcaggcatatgggcaatcttaaggaataatgaaatgctaacatggccagagaaaatcaagtttgctattggtctcttacctgctatggctggtggacagtcctatgtcgaggcacaagatggtttaagtgttcaagagtggatgaaaaaacaagtaggaacaaacgatca

SEQ ID NO: 1650 - DNA, 200 bp, Kochia scoparia
tgatcgtttgttcctacttgttttttcatccactcttgaacacttaaaccatcttgtgcctcgacataggactgtccaccagccatagcaggtaagagaccaatagcaaacttgattttctctggccatgttagcatttcattattccttaagattgcccatatgcctgccaaacacattaagaatgaacagaatcaaaa

SEQ ID NO: 1651 - DNA, 200 bp, Kochia scoparia
aaaaacaagtaggaacaaacgatcatttttaaaaccttatttttcaaattccttgatgattgtctagattgttagttcattacatgtctaactttaaacattgatgttacagggacatctattttatttatttttgaaaattccttttgcaaattttgtagggtgtgcctgatcgtgttacagatgaagtattcattgcc

SEQ ID NO: 1652 - DNA, 200 bp, Kochia scoparia
ggcaatgaatacttcatctgtaacacgatcaggcacaccctacaaaatttgcaaaaggaattttcaaaaataaataaaatagatgtccctgtaacatcaatgtttaaagttagacatgtaatgaactaacaatctagacaatcatcaaggaatttgaaaaataaggttttaaaaatgatcgtttgttcctacttgttttt

SEQ ID NO: 1653 - DNA, 200 bp, Kochia scoparia
tgttacagatgaagtattcattgccatgtcaaaggcacttaacttcataaatccggatgaactttcgatgcagtgtatcttgattgctctgaatcgatttcttcaggtatagccccatttcactatctgctttaagtgtgttttattttcaattgaattcgacctattcaactatatggaacttaagtaattttgatttg

SEQ ID NO: 1654 - DNA, 200 bp, Kochia scoparia
caaatcaaaattacttaagttccatatagttgaataggtcgaattcaattgaaaataaaacacacttaaagcagatagtgaaatggggctatacctgaagaaatcgattcagagcaatcaagatacactgcatcgaaagttcatccggatttatgaagttaagtgcctttgacatggcaatgaatacttcatctgtaaca

SEQ ID NO: 1655 - DNA, 200 bp, Kochia scoparia
atggaacttaagtaattttgatttgaacttattgatacaaacgtatcaaaacttacgataatctttttcagtttgatacactatcgttttgtttctgagaactttttgtaaattggattatatgtgatgttaaaattatggaattcactcaacaggaaaagcatggttcaaaaatggctttcttggatggaaatcctcca

SEQ ID NO: 1656 - DNA, 200 bp, Kochia scoparia
tggaggatttccatccaagaaagccatttttgaaccatgcttttcctgttgagtgaattccataattttaacatcacatataatccaatttacaaaaagttctcagaaacaaaacgatagtgtatcaaactgaaaaagattatcgtaagttttgatacgtttgtatcaataagttcaaatcaaaattacttaagttccat

SEQ ID NO: 1657 - DNA, 200 bp, Kochia scoparia
ggctttcttggatggaaatcctccagaaaggttatgcatgcctattgttgagcatattgagtcactaggtggtgaagtgcagcttaactctcgtattcaaaagataaagttaactcaagatggaagtgtggatagcttcttgctaaccaatgggaaagaagttagaggggatgcttacgtctttgctactccaggtttac

SEQ ID NO: 1658 - DNA, 200 bp, Kochia scoparia
gtaaacctggagtagcaaagacgtaagcatcccctctaacttctttcccattggttagcaagaagctatccacacttccatcttgagttaactttatcttttgaatacgagagttaagctgcacttcaccacctagtgactcaatatgctcaacaataggcatgcataacctttctggaggatttccatccaagaaagcc

SEQ ID NO: 1659 - DNA, 200 bp, Kochia scoparia
tacgtctttgctactccaggtttacttttcttctttaccgaatgggattattattcaactaggaaattattgccatttttagtcaagacaggctcctgaagaaattatttattgccatctgtattgttctctgatatacctttaaatttttattacagttgacatcctaaagctacttcttcctgaagagtggaaagaaa

SEQ ID NO: 1660 - DNA, 200 bp, Kochia scoparia
tttctttccactcttcaggaagaagtagctttaggatgtcaactgtaataaaaatttaaaggtatatcagagaacaatacagatggcaataaataatttcttcaggagcctgtcttgactaaaaatggcaataatttcctagttgaataataatcccattcggtaaagaagaaaagtaaacctggagtagcaaagacgta

SEQ ID NO: 1661 - DNA, 200 bp, Kochia scoparia
cttcttcctgaagagtggaaagaaatttcatacttcaaaaagttggagaaactagtaggagttcctgtcattaatgttcacatatggttagtgatacctcttgtctacaggaatatagtttcttaatgctataacccaatcttatgtgtcttctcttactctatgtaattttatttatgtatctatctttctcttccatg

SEQ ID NO: 1662 - DNA, 200 bp, Kochia scoparia
catggaagagaaagatagatacataaataaaattacatagagtaagagaagacacataagattgggttatagcattaagaaactatattcctgtagacaagaggtatcactaaccatatgtgaacattaatgacaggaactcctactagtttctccaactttttgaagtatgaaatttctttccactcttcaggaagaag

SEQ ID NO: 1663 - DNA, 200 bp, Kochia scoparia
tatgtatctatctttctcttccatgtccatgtattttgttatttctgtctttggctttttagaatggtttgtcagtatatctttgcaattaggctctgatttaatagcctgctactatacgaagtatatcatttctttggtagtgtattttctgtagtttgcgttgagagtttgagactcctatacgtagagcttcatct

SEQ ID NO: 1664 - DNA, 200 bp, Kochia scoparia
agatgaagctctacgtataggagtctcaaactctcaacgcaaactacagaaaatacactaccaaagaaatgatatacttcgtatagtagcaggctattaaatcagagcctaattgcaaagatatactgacaaaccattctaaaaagccaaagacagaaataacaaaatacatggacatggaagagaaagatagatacata

SEQ ID NO: 1665 - DNA, 200 bp, Kochia scoparia
gactcctatacgtagagcttcatcttaataaaattttatgtcttgtaaaatctgtctgttttgaaatgtcaaaaaagctgtcaaaatctatttctcaccctctccttatgaagaacttcaatgaaatctcctctaatatcgggactgacatttaacaactgttggcttgcaggtttgataggaaattgaagaatacatat

SEQ ID NO: 1666 - DNA, 200 bp, Kochia scoparia
atatgtattcttcaatttcctatcaaacctgcaagccaacagttgttaaatgtcagtcccgatattagaggagatttcattgaagttcttcataaggagagggtgagaaatagattttgacagcttttttgacatttcaaaacagacagattttacaagacataaaattttattaagatgaagctctacgtataggagtc

SEQ ID NO: 1667 - DNA, 200 bp, Kochia scoparia
tgataggaaattgaagaatacatatgaccacctactcttcagcaggtgtgttcaattaaagtgctaaattcaatatcattttcatagcactcaaacaatactcaaagattatccttccctttttgtccttgttttatactcatttcgttttccctttttttgttggaaagcacattttgttgagcatatgccatgagctg

SEQ ID NO: 1668 - DNA, 200 bp, Kochia scoparia
cagctcatggcatatgctcaacaaaatgtgctttccaacaaaaaaagggaaaacgaaatgagtataaaacaaggacaaaaagggaaggataatctttgagtattgtttgagtgctatgaaaatgatattgaatttagcactttaattgaacacacctgctgaagagtaggtggtcatatgtattcttcaatttcctatca

SEQ ID NO: 1669 - DNA, 200 bp, Kochia scoparia
tttgttgagcatatgccatgagctgcatacttgcataaaattgggcaaaggagccacagtcatttgatatatatgatttaagaatcctcctatgaagttagaaaagttatggtactagttttcttttactgagtgaacggggtatccctgccagcaatgtgtacaaggatactggcttgctgcagaaagatactttcagt

SEQ ID NO: 1670 - DNA, 200 bp, Kochia scoparia
actgaaagtatctttctgcagcaagccagtatccttgtacacattgctggcagggataccccgttcactcagtaaaagaaaactagtaccataacttttctaacttcataggaggattcttaaatcatatatatcaaatgactgtggctcctttgcccaattttatgcaagtatgcagctcatggcatatgctcaacaaa

SEQ ID NO: 1671 - DNA, 200 bp, Kochia scoparia
cttgctgcagaaagatactttcagtattgataagatacaaattgcatttttcttttggatgaaatacagtgaactggcaatggtgtcagcttgaacgttgagaatccttgatatccatttgattcatgttttcacttgtgcgcggatttcactcctataagtttgtcattgcaggagtcctcttttgagtgtctatgctg

SEQ ID NO: 1672 - DNA, 200 bp, Kochia scoparia
cagcatagacactcaaaagaggactcctgcaatgacaaacttataggagtgaaatccgcgcacaagtgaaaacatgaatcaaatggatatcaaggattctcaacgttcaagctgacaccattgccagttcactgtatttcatccaaaagaaaaatgcaatttgtatcttatcaatactgaaagtatctttctgcagcaag

SEQ ID NO: 1673 - DNA, 200 bp, Kochia scoparia
agtcctcttttgagtgtctatgctgatatgtcagagacatgcaaggtaatttctcctcaattttgttcttcatcatgtaatacatgctgtctcattcgcaaacgtctactatgtgctattcaatcgaaggcatatgtaatgttatttaatcaaaagcatatactgtatataagtgctttgtcacttccaaaactatgtct

SEQ ID NO: 1674 - DNA, 200 bp, Kochia scoparia
agacatagttttggaagtgacaaagcacttatatacagtatatgcttttgattaaataacattacatatgccttcgattgaatagcacatagtagacgtttgcgaatgagacagcatgtattacatgatgaagaacaaaattgaggagaaattaccttgcatgtctctgacatatcagcatagacactcaaaagaggact

SEQ ID NO: 1675 - DNA, 200 bp, Kochia scoparia
ctttgtcacttccaaaactatgtctgttttttaatcccctatcgatttttttatttgttatttatttcttaattgttttgttagcttgttatatgtttgtctttgagactttttggttgttatcattgaacatctttatgacttactcctttcggaatcaagttacacatacaatgaaagtgtgtatgattaaatttgtc

SEQ ID NO: 1676 - DNA, 200 bp, Kochia scoparia
gacaaatttaatcatacacactttcattgtatgtgtaacttgattccgaaaggagtaagtcataaagatgttcaatgataacaaccaaaaagtctcaaagacaaacatataacaagctaacaaaacaattaagaaataaataacaaataaaaaaatcgataggggattaaaaaacagacatagttttggaagtgacaaag

SEQ ID NO: 1677 - DNA, 200 bp, Kochia scoparia
gaaagtgtgtatgattaaatttgtcaataggctattatttgtttgagtgatgaggagatgataactttattcctactataaagaaaaggtctactttaaaacctcgtcttgtcattaattatgagggttggatgttgggattgagataaatcaactgataccagaacccagaaggggaaaatgcagaaatactacctcat

SEQ ID NO: 1678 - DNA, 200 bp, Kochia scoparia
atgaggtagtatttctgcattttccccttctgggttctggtatcagttgatttatctcaatcccaacatccaaccctcataattaatgacaagacgaggttttaaagtagaccttttctttatagtaggaataaagttatcatctcctcatcactcaaacaaataatagcctattgacaaatttaatcatacacactttc

SEQ ID NO: 1679 - DNA, 200 bp, Kochia scoparia
ggaaaatgcagaaatactacctcatgagctgtggctgacctttctgttcccatgatcttgtcttattctatgagtatgaactaaagtagtagagtgttcccaatcttttggagcgtacaggaatattatgatccaaaccggtccatgctggaattggtttttgcacctgcagaagaatgggtttctcggagtgacacgga

SEQ ID NO: 1680 - DNA, 200 bp, Kochia scoparia
tccgtgtcactccgagaaacccattcttctgcaggtgcaaaaaccaattccagcatggaccggtttggatcataatattcctgtacgctccaaaagattgggaacactctactactttagttcatactcatagaataagacaagatcatgggaacagaaaggtcagccacagctcatgaggtagtatttctgcattttcc

SEQ ID NO: 1681 - DNA, 200 bp, Kochia scoparia
aatgggtttctcggagtgacacggacattattgaggcaacaatgaacgaacttgccaagctttttcctgatgaaatcgcagctgatgggagcaaggctaagatcctaaaatatcatgtagtcaaaactcccaggtgagataatatgtactatactgctctgtattagttagatttggtaatcgtttgtggtattaagcag

SEQ ID NO: 1682 - DNA, 200 bp, Kochia scoparia
ctgcttaataccacaaacgattaccaaatctaactaatacagagcagtatagtacatattatctcacctgggagttttgactacatgatattttaggatcttagccttgctcccatcagctgcgatttcatcaggaaaaagcttggcaagttcgttcattgttgcctcaataatgtccgtgtcactccgagaaacccatt

SEQ ID NO: 1683 - DNA, 200 bp, Kochia scoparia
ggtaatcgtttgtggtattaagcagaccttatctgctgaaaagcagtatcgatatttactactgttaaggtctctaactgttaattcttccattccttcacaggtctgtttataagacagttccaaactgtgaaccttgtcgaccattgcaaaggtcaccaatagaaggtttctatttatccggtgattacacaaagcaa

SEQ ID NO: 1684 - DNA, 200 bp, Kochia scoparia
ttgctttgtgtaatcaccggataaatagaaaccttctattggtgacctttgcaatggtcgacaaggttcacagtttggaactgtcttataaacagacctgtgaaggaatggaagaattaacagttagagaccttaacagtagtaaatatcgatactgcttttcagcagataaggtctgcttaataccacaaacgattacc

SEQ ID NO: 1685 - DNA, 200 bp, Kochia scoparia
tttatccggtgattacacaaagcaaaaatatttggcttcaatggaaggtgctgtcctgtctgggaagttttgtgcacaggctattgtacaggtaatgaggttttgctcaaacatcataagcatgatattcatgagtttcacttcctatatctcctagcatactcatgatattgttactctataaattatgtttactgaaa

SEQ ID NO: 1686 - DNA, 200 bp, Kochia scoparia
tttcagtaaacataatttatagagtaacaatatcatgagtatgctaggagatataggaagtgaaactcatgaatatcatgcttatgatgtttgagcaaaacctcattacctgtacaatagcctgtgcacaaaacttcccagacaggacagcaccttccattgaagccaaatatttttgctttgtgtaatcaccggataaa

SEQ ID NO: 1687 - DNA, 200 bp, Kochia scoparia
actctataaattatgtttactgaaaatttaatcctattattcatttgcaggattatgatatgcttgttgctcgagcacaaagagaattggcaggggcaggcaacgcctgatttgaaattctttgatatttgcccatttttttcgtcggagatttggattggtgatcttgttcagatcgagttcagatcgatattcaacta

SEQ ID NO: 1688 - DNA, 200 bp, Kochia scoparia
tagttgaatatcgatctgaactcgatctgaacaagatcaccaatccaaatctccgacgaaaaaaatgggcaaatatcaaagaatttcaaatcaggcgttgcctgcccctgccaattctctttgtgctcgagcaacaagcatatcataatcctgcaaatgaataataggattaaattttcagtaaacataatttatagagt

SEQ ID NO: 1689 - DNA, 200 bp, Kochia scoparia
tcgagttcagatcgatattcaactactggaaacaaactctgggaagcattctcagttatactcaattttttttctgctgttcaagatgtatatgtgtagcttaattgtagggaaacatgtacaggcatgtactcgtaagtggtttcaaatgtaagtagtaattcaatacatgtactaacatttctgtggaaataggaaac

SEQ ID NO: 1690 - DNA, 200 bp, Kochia scoparia
gtttcctatttccacagaaatgttagtacatgtattgaattactacttacatttgaaaccacttacgagtacatgcctgtacatgtttccctacaattaagctacacatatacatcttgaacagcagaaaaaaaattgagtataactgagaatgcttcccagagtttgtttccagtagttgaatatcgatctgaactcga

SEQ ID NO: 1691 - DNA, 200 bp, Kochia scoparia
taacatttctgtggaaataggaaactgttttagaagagtgtcccctttatacttcgtaaatgacatttagattgtggctttgttgctgggagcatggtccggcttggttaggaagcacgaggccattgcccgaatgccgccaatgtggattgatggatcttctcttagcttcttaaggggttagtctttttccatgatac

SEQ ID NO: 1692 - DNA, 200 bp, Kochia scoparia
gtatcatggaaaaagactaaccccttaagaagctaagagaagatccatcaatccacattggcggcattcgggcaatggcctcgtgcttcctaaccaagccggaccatgctcccagcaacaaagccacaatctaaatgtcatttacgaagtataaaggggacactcttctaaaacagtttcctatttccacagaaatgtta

SEQ ID NO: 1693 - DNA, 200 bp, Kochia scoparia
aggggttagtctttttccatgatacttcctcagttattgaaagaatgtaaaccttttttttttttttcattttgtcgtgaaacttcgcaattttcaatcttatacgtgtatgaaacttcgatattacttctccatatttttaatcacaacacgtatggattgccggattggcaataaagttgatgatagagaaaatatgt

SEQ ID NO: 1694 - DNA, 200 bp, Kochia scoparia
acatattttctctatcatcaactttattgccaatccggcaatccatacgtgttgtgattaaaaatatggagaagtaatatcgaagtttcatacacgtataagattgaaaattgcgaagtttcacgacaaaatgaaaaaaaaaaaaaaggtttacattctttcaataactgaggaagtatcatggaaaaagactaacccct

SEQ ID NO: 1695 - DNA, 200 bp, Kochia scoparia
aaagttgatgatagagaaaatatgtgggggcatatgaaattcttgtgagagtaaagtggtggtcttgtataccattttaaaaacgtcgtaaacattttgaatcaactcaaaaatataaaaagtgtcccctttatacttcattcatttgcatttggacatccctttcaaatattgctaagcttagcttagcgattagggtt

SEQ ID NO: 1696 - DNA, 200 bp, Kochia scoparia
aaccctaatcgctaagctaagcttagcaatatttgaaagggatgtccaaatgcaaatgaatgaagtataaaggggacactttttatatttttgagttgattcaaaatgtttacgacgtttttaaaatggtatacaagaccaccactttactctcacaagaatttcatatgcccccacatattttctctatcatcaacttt

SEQ ID NO: 1697 - DNA, 200 bp, Kochia scoparia
taagcttagcttagcgattagggttgaaccttttaaccttgaggatgcaggttaaatttttactaaagcatttcggggtttttctattattactctttcccccctacttttaaagcgtctagtcatcaaacttacagcggatcgatgtttgaatacgataacgttatcctacaaaaaagaagaaagggtacctcaacccc

SEQ ID NO: 1698 - DNA, 200 bp, Kochia scoparia
ggggttgaggtaccctttcttcttttttgtaggataacgttatcgtattcaaacatcgatccgctgtaagtttgatgactagacgctttaaaagtaggggggaaagagtaataatagaaaaaccccgaaatgctttagtaaaaatttaacctgcatcctcaaggttaaaaggttcaaccctaatcgctaagctaagctta

SEQ ID NO: 1699 - DNA, 200 bp, Kochia scoparia
aaagaagaaagggtacctcaaccccaattccccaagacctactcccaaagtccaaaacaacatgagtggatttgcaagttgcaaataggcattaggcatatattatttgggcaaaatagtagtaattggagttgcgttgtgcattctttgaagattaactacttgagtgtgcgtgcagtcggtgccgtcagtaacaaact

SEQ ID NO: 1700 - DNA, 200 bp, Kochia scoparia
agtttgttactgacggcaccgactgcacgcacactcaagtagttaatcttcaaagaatgcacaacgcaactccaattactactattttgcccaaataatatatgcctaatgcctatttgcaacttgcaaatccactcatgttgttttggactttgggagtaggtcttggggaattggggttgaggtaccctttcttcttt

SEQ ID NO: 1701 - DNA, 200 bp, Kochia scoparia
cagtcggtgccgtcagtaacaaactacatacacatcacatctcgagggatgaaccccccattaagctactctacaagaaccatgaacctccatggggacacccacactatgctactaagcaaaatccttaacatcctcgactagatatatacttcttccgtttctttttactgtaaatgcaacaaaagtatctttctgtt

SEQ ID NO: 1702 - DNA, 200 bp, Kochia scoparia
aacagaaagatacttttgttgcatttacagtaaaaagaaacggaagaagtatatatctagtcgaggatgttaaggattttgcttagtagcatagtgtgggtgtccccatggaggttcatggttcttgtagagtagcttaatggggggttcatccctcgagatgtgatgtgtatgtagtttgttactgacggcaccgactg

SEQ ID NO: 1703 - DNA, 200 bp, Kochia scoparia
aatgcaacaaaagtatctttctgttttcacaaatgtcgatttggcttgtaaagcttgtgaattggctcgatttttatttttcttttgcagtttcataaaattcgttacacttttcattctaagatgatctcacattacttgctatacttttttttgtactaaactatttattatatatctcttctcacatgagtcctcct

SEQ ID NO: 1704 - DNA, 200 bp, Kochia scoparia
aggaggactcatgtgagaagagatatataataaatagtttagtacaaaaaaaagtatagcaagtaatgtgagatcatcttagaatgaaaagtgtaacgaattttatgaaactgcaaaagaaaaataaaaatcgagccaattcacaagctttacaagccaaatcgacatttgtgaaaacagaaagatacttttgttgcatt

SEQ ID NO: 1705 - DNA, 200 bp, Kochia scoparia
tatctcttctcacatgagtcctccttgcttttttattctctatctcttccctctccaaaaatcagtgaattgagaaatgtagcgagtaatatgaaatggaagaagtactttggaaaacatttgtactatcaatacatacatgaaaacaatgatcctatctattatatatatgacaagattaagaaatttactgtctatta

SEQ ID NO: 1706 - DNA, 200 bp, Kochia scoparia
taatagacagtaaatttcttaatcttgtcatatatataatagataggatcattgttttcatgtatgtattgatagtacaaatgttttccaaagtacttcttccatttcatattactcgctacatttctcaattcactgatttttggagagggaagagatagagaataaaaaagcaaggaggactcatgtgagaagagata

SEQ ID NO: 1707 - DNA, 200 bp, Kochia scoparia
agattaagaaatttactgtctattaaaaccaacaaattgaatattaattgaagaagaaaaggaaaacataaaaactgaaggtaacaatgtactgtataaaacttgttcatgaatagtttgaaaaaaggttcgaacaacaattggtcaaaacttaaattaacaaactcaaagtcgagattaagctcgagtaaacttaaaca

SEQ ID NO: 1708 - DNA, 200 bp, Kochia scoparia
tgtttaagtttactcgagcttaatctcgactttgagtttgttaatttaagttttgaccaattgttgttcgaaccttttttcaaactattcatgaacaagttttatacagtacattgttaccttcagtttttatgttttccttttcttcttcaattaatattcaatttgttggttttaatagacagtaaatttcttaatct

SEQ ID NO: 1709 - DNA, 200 bp, Kochia scoparia
gattaagctcgagtaaacttaaacaaacactaaccgagcttatttttttagtttttttaataaaatcacaaaacattagaaaaaaaaatctagaatacaccaagtgtaacaaagaaatgttgtccttttactcgaataagattcacaagccttatacaaatccttaattagcattacattatttacatgatacattgcat

SEQ ID NO: 1710 - DNA, 200 bp, Kochia scoparia
atgcaatgtatcatgtaaataatgtaatgctaattaaggatttgtataaggcttgtgaatcttattcgagtaaaaggacaacatttctttgttacacttggtgtattctagatttttttttctaatgttttgtgattttattaaaaaaactaaaaaaataagctcggttagtgtttgtttaagtttactcgagcttaatc

SEQ ID NO: 1711 - DNA, 200 bp, Kochia scoparia
acattatttacatgatacattgcattggggcacaattatataaccaaggatcatgataacccaccattattttttcaattagataagttgataccattgcttaaaatcttaacaaaaaatctatatatcaaccttaataaaatttaaaatataaggtttacaatattatttaataaaattgatatcaacattcttagctt

SEQ ID NO: 1712 - DNA, 200 bp, Kochia scoparia
aagctaagaatgttgatatcaattttattaaataatattgtaaaccttatattttaaattttattaaggttgatatatagattttttgttaagattttaagcaatggtatcaacttatctaattgaaaaaataatggtgggttatcatgatccttggttatataattgtgccccaatgcaatgtatcatgtaaataatgt

SEQ ID NO: 1713 - DNA, 200 bp, Kochia scoparia
aaattgatatcaacattcttagctttttggtgcatgttgtaacttagaaaatggtttgattttattttcatgcaccacaaatgaggctaatcatctcacttcaactcacacatacaagagctgttatgaactcctattctgaagcccaatttactgaaccttgagattgagattaaatttgtccttttatttgaacctta

SEQ ID NO: 1714 - DNA, 200 bp, Kochia scoparia
taaggttcaaataaaaggacaaatttaatctcaatctcaaggttcagtaaattgggcttcagaataggagttcataacagctcttgtatgtgtgagttgaagtgagatgattagcctcatttgtggtgcatgaaaataaaatcaaaccattttctaagttacaacatgcaccaaaaagctaagaatgttgatatcaattt

SEQ ID NO: 1715 - DNA, 200 bp, Kochia scoparia
aatttgtccttttatttgaaccttaaagtgtaattaaagtttaaagtttttgttctaataataatattccttaaacagatattttttttttatatgattgttctctttaagatgcatgtttagaagcaataattctcacatatttaagaaagtgctaatttgaggtaattgtgttggatgattgggtgcgaatgagccgc

SEQ ID NO: 1716 - DNA, 200 bp, Kochia scoparia
gcggctcattcgcacccaatcatccaacacaattacctcaaattagcactttcttaaatatgtgagaattattgcttctaaacatgcatcttaaagagaacaatcatataaaaaaaaaatatctgtttaaggaatattattattagaacaaaaactttaaactttaattacactttaaggttcaaataaaaggacaaatt

SEQ ID NO: 1717 - DNA, 200 bp, Kochia scoparia
ggatgattgggtgcgaatgagccgcaatgctgaataacggacttttattaatattaaccattaaaccaagacttcataataaccccctatgaaatgtcccttatacccttaatgaattaaattacaatatttaaaaaaaattaataatatatttttactcttcaattgtcaatttgccataaatgttgaataagtttaat

SEQ ID NO: 1718 - DNA, 200 bp, Kochia scoparia
attaaacttattcaacatttatggcaaattgacaattgaagagtaaaaatatattattaattttttttaaatattgtaatttaattcattaagggtataagggacatttcatagggggttattatgaagtcttggtttaatggttaatattaataaaagtccgttattcagcattgcggctcattcgcacccaatcatcc

SEQ ID NO: 1719 - DNA, 200 bp, Kochia scoparia
aggaaaatctagatgaaatcacaaaacaaaacccactaaactatacttatcctagaaaagtaaaagcattcaattagtgatgagaagcttaagcatacgctgcacaaaaacaaccaactaatcaactcatagaaaacagcaactgatgtcagtaagtagtttctaaaattttaccttccttgcaagagatgaccaagccc

SEQ ID NO: 1720 - DNA, 200 bp, Kochia scoparia
gggcttggtcatctcttgcaaggaaggtaaaattttagaaactacttactgacatcagttgctgttttctatgagttgattagttggttgtttttgtgcagcgtatgcttaagcttctcatcactaattgaatgcttttacttttctaggataagtatagtttagtgggttttgttttgtgatttcatctagattttcct

SEQ ID NO: 1721 - DNA, 200 bp, Kochia scoparia
ttccttgcaagagatgaccaagcccaactgtcccgaacacggtcagggaaatgagaggaaggccatatctcataaatgggttccttctccccaatctctttaatcctgaatactgaaagcctggaaaagcagcagctttctttgaatcattaactggcgctctcgcaacgactgtcatgtttctccctctaaatatgact

SEQ ID NO: 1722 - DNA, 200 bp, Kochia scoparia
agtcatatttagagggagaaacatgacagtcgttgcgagagcgccagttaatgattcaaagaaagctgctgcttttccaggctttcagtattcaggattaaagagattggggagaaggaacccatttatgagatatggccttcctctcatttccctgaccgtgttcgggacagttgggcttggtcatctcttgcaaggaa

SEQ ID NO: 1723 - DNA, 200 bp, Kochia scoparia
catgtttctccctctaaatatgactctgaagttccaatttcactcagaaattagttgttcaacttagcaatcaaacaaatttaactaatttgtagcttaaacacttgtaagaacaacatctggaaaacccacatcaagttttgttcaacgaaagcaccataattgatccataaaccaagaaaactggcaaattcatactc

SEQ ID NO: 1724 - DNA, 200 bp, Kochia scoparia
gagtatgaatttgccagttttcttggtttatggatcaattatggtgctttcgttgaacaaaacttgatgtgggttttccagatgttgttcttacaagtgtttaagctacaaattagttaaatttgtttgattgctaagttgaacaactaatttctgagtgaaattggaacttcagagtcatatttagagggagaaacatg

SEQ ID NO: 1725 - DNA, 200 bp, Kochia scoparia
caagaaaactggcaaattcatactcctcatcaaacatttcgacattcatagtttcaaaaagtagaatgataattttagaaagtcgtttatacttcaaaattgcaaagaataagacgcataacgtactgtatccataaacgattgaaaaaaaataattcatgcttttgattgatattctgtgccttgtaaaaatatctgta

SEQ ID NO: 1726 - DNA, 200 bp, Kochia scoparia
tacagatatttttacaaggcacagaatatcaatcaaaagcatgaattattttttttcaatcgtttatggatacagtacgttatgcgtcttattctttgcaattttgaagtataaacgactttctaaaattatcattctactttttgaaactatgaatgtcgaaatgtttgatgaggagtatgaatttgccagttttcttg

SEQ ID NO: 1727 - DNA, 200 bp, Kochia scoparia
tctgtgccttgtaaaaatatctgtaatagcgcaattaattgacacttgcaaaagctcaaatcaaaacgctaaagttaaatcacaaatagcaactaatcaaattcataatttgtcgaaagtatgaatgaggttaaagttacacaaaatacctgaaaatggcgaaaataatgcggaaaaatctttattcttctttagctcgt

SEQ ID NO: 1728 - DNA, 200 bp, Kochia scoparia
acgagctaaagaagaataaagatttttccgcattattttcgccattttcaggtattttgtgtaactttaacctcattcatactttcgacaaattatgaatttgattagttgctatttgtgatttaactttagcgttttgatttgagcttttgcaagtgtcaattaattgcgctattacagatatttttacaaggcacaga

SEQ ID NO: 1729 - DNA, 200 bp, Kochia scoparia
aaatctttattcttctttagctcgttcttcttctgcaagaagcaaacttgattttaggatatgctaatttcgcaaaccagaatttagggttcgtttggtagggcgtaaaacgttttcaaatgaaaatagttttcattgaaaaacattttacaattgaaaactcattttcatacaagttttctattgtttggttgaatgga

SEQ ID NO: 1730 - DNA, 200 bp, Kochia scoparia
tccattcaaccaaacaatagaaaacttgtatgaaaatgagttttcaattgtaaaatgtttttcaatgaaaactattttcatttgaaaacgttttacgccctaccaaacgaaccctaaattctggtttgcgaaattagcatatcctaaaatcaagtttgcttcttgcagaagaagaacgagctaaagaagaataaagattt

SEQ ID NO: 1731 - DNA, 200 bp, Kochia scoparia
gttttctattgtttggttgaatggaaaatgatacaaaaggtttattgttttatttttattatcaaaaatatttttttaaaaaataaaatcaaaatccagattgattaataaattaaaacgtcgaataatgtagcaaatagtgttattgatatcaatcaatcatgattttgatgaaaatacaatcaagaattcttaagcaa

SEQ ID NO: 1732 - DNA, 200 bp, Kochia scoparia
ttgcttaagaattcttgattgtattttcatcaaaatcatgattgattgatatcaataacactatttgctacattattcgacgttttaatttattaatcaatctggattttgattttattttttaaaaaaatatttttgataataaaaataaaacaataaaccttttgtatcattttccattcaaccaaacaatagaaaac

SEQ ID NO: 1733 - DNA, 200 bp, Kochia scoparia
aatacaatcaagaattcttaagcaaaatcttgatgcgcgtccacaacatccgaaaaataaacattaatttggtttatcaggatgatttccagaaatttatggaaaatcgaaaatttcaaaatcatccaaaaattcgcgtcaacttttatcaataatcaaacatcaaaattcaatcaattacctatgtagttgaaatatca

SEQ ID NO: 1734 - DNA, 200 bp, Kochia scoparia
tgatatttcaactacataggtaattgattgaattttgatgtttgattattgataaaagttgacgcgaatttttggatgattttgaaattttcgattttccataaatttctggaaatcatcctgataaaccaaattaatgtttatttttcggatgttgtggacgcgcatcaagattttgcttaagaattcttgattgtatt

SEQ ID NO: 1735 - DNA, 200 bp, Kochia scoparia
aattacctatgtagttgaaatatcaatctatccaataatccagcaataatacaataatcaaatactgaaattccagaaaaaaacattcatcttgtcatcttgattgctgctaccatatcttcattagatcttcttccccaattgattattaaaccaaatgaattatttaggatttttgaaatatttgaattgattgtaaa

SEQ ID NO: 1736 - DNA, 200 bp, Kochia scoparia
tttacaatcaattcaaatatttcaaaaatcctaaataattcatttggtttaataatcaattggggaagaagatctaatgaagatatggtagcagcaatcaagatgacaagatgaatgtttttttctggaatttcagtatttgattattgtattattgctggattattggatagattgatatttcaactacataggtaatt

SEQ ID NO: 1737 - DNA, 200 bp, Kochia scoparia
ttgaaatatttgaattgattgtaaaaattgaaagaaattcgagaccggcaaagaattgaagaagatggaaattcgaggcaaagaattgaagaattgaagaattgaagaattgaagtgaagttgttgaaattgaattgtactgtgcgaattcaaaagagagttatgatagagaaagtgtagatgttagatgtcgtatgatg

SEQ ID NO: 1738 - DNA, 200 bp, Kochia scoparia
catcatacgacatctaacatctacactttctctatcataactctcttttgaattcgcacagtacaattcaatttcaacaacttcacttcaattcttcaattcttcaattcttcaattctttgcctcgaatttccatcttcttcaattctttgccggtctcgaatttctttcaatttttacaatcaattcaaatatttcaa

SEQ ID NO: 1739 - DNA, 200 bp, Kochia scoparia
tgtagatgttagatgtcgtatgatggcagaagaaagtacgaaacaaaggaaaaccttttcctttgatttttgaaggaaaagattttcaattggaatgtaaaataattttacactcaagttttccattttattttttcaatcttaccaaacaatgtaaaataggaaaatagttttcagggaaaatgttttacgccctacca

SEQ ID NO: 1740 - DNA, 200 bp, Kochia scoparia
tggtagggcgtaaaacattttccctgaaaactattttcctattttacattgtttggtaagattgaaaaaataaaatggaaaacttgagtgtaaaattattttacattccaattgaaaatcttttccttcaaaaatcaaaggaaaaggttttcctttgtttcgtactttcttctgccatcatacgacatctaacatctaca

SEQ ID NO: 1741 - DNA, 200 bp, Kochia scoparia
agggaaaatgttttacgccctaccaaacactaccttaatcttggcggttgagagatttcatctcaataattaaaagtataaaatccaagaagaaaagattaccaaaaaacttggagaaagaaattgattaagagatgatgagatatggcagtaccgcgattaccgaacaaagattgaaatgatgatgagatgatgatgat

SEQ ID NO: 1742 - DNA, 200 bp, Kochia scoparia
atcatcatcatctcatcatcatttcaatctttgttcggtaatcgcggtactgccatatctcatcatctcttaatcaatttctttctccaagttttttggtaatcttttcttcttggattttatacttttaattattgagatgaaatctctcaaccgccaagattaaggtagtgtttggtagggcgtaaaacattttccct

SEQ ID NO: 1743 - DNA, 200 bp, Kochia scoparia
gaaatgatgatgagatgatgatgatgatgatgattgatgatgatgatgatgaattgatgatgagctagctcgaaaacggatttgtgcgggtaatggctcaaacgattctgaagactacgttattcatccattttggtcgctagtgggcatgacttgagtaaaatggattgaagtgacggctagattggatttggggctag

SEQ ID NO: 1744 - DNA, 200 bp, Kochia scoparia
ctagccccaaatccaatctagccgtcacttcaatccattttactcaagtcatgcccactagcgaccaaaatggatgaataacgtagtcttcagaatcgtttgagccattacccgcacaaatccgttttcgagctagctcatcatcaattcatcatcatcatcatcaatcatcatcatcatcatcatctcatcatcatttc

SEQ ID NO: 1745 - DNA, 200 bp, Kochia scoparia
acggctagattggatttggggctagccaagacataagaatcgtttgggttaatcgttaaccgttaagagtgggtcgagactaatataggagcaacttttcgttcgaaacccaaaaaaaaaaaaacaaaacaaagcacatgatgaatactgaataaaaaaataattaattggatccatcttatatgcctaaggcgtaccca

SEQ ID NO: 1746 - DNA, 200 bp, Kochia scoparia
tgggtacgccttaggcatataagatggatccaattaattatttttttattcagtattcatcatgtgctttgttttgtttttttttttttgggtttcgaacgaaaagttgctcctatattagtctcgacccactcttaacggttaacgattaacccaaacgattcttatgtcttggctagccccaaatccaatctagccgt

SEQ ID NO: 1747 - DNA, 200 bp, Kochia scoparia
atcttatatgcctaaggcgtacccaaaagtcatgaaggttggctgatcctatctacggaatacacaatgcttaaacaattaaaattaacatactttgtaggtgaggcatgcttggtttgatcaaatttagacatgagtgacgaattgaatcttgcctaataggatcaaactcatgaagttatgatatgacatgcactatg

SEQ ID NO: 1748 - DNA, 200 bp, Kochia scoparia
catagtgcatgtcatatcataacttcatgagtttgatcctattaggcaagattcaattcgtcactcatgtctaaatttgatcaaaccaagcatgcctcacctacaaagtatgttaattttaattgtttaagcattgtgtattccgtagataggatcagccaaccttcatgacttttgggtacgccttaggcatataagat

SEQ ID NO: 1749 - DNA, 200 bp, Kochia scoparia
aagttatgatatgacatgcactatggattattttttgcatgagatttttataaaacttgatataatctacctaactaatgtatgtcctgattgacatttgagttgtccaataacgtaccacgacatcaattcaagagttcttcgaagaaaataagtaaataaccccaatctcaaggataaggagatttgaaggctaaaaa

SEQ ID NO: 1750 - DNA, 200 bp, Kochia scoparia
tttttagccttcaaatctccttatccttgagattggggttatttacttattttcttcgaagaactcttgaattgatgtcgtggtacgttattggacaactcaaatgtcaatcaggacatacattagttaggtagattatatcaagttttataaaaatctcatgcaaaaaataatccatagtgcatgtcatatcataactt

SEQ ID NO: 1751 - DNA, 200 bp, Kochia scoparia
gataaggagatttgaaggctaaaaaaacttgatctacccattgagtagactacccaccattaattgacagtggtaaaaagtggtgacaatagaattacactcaagttatgaaacaatagatatgtatatgcgatccattaagtaaatgtaatcatgtccgagccgaagggatcaagcctagacaccagtcaagcttgggt

SEQ ID NO: 1752 - DNA, 200 bp, Kochia scoparia
acccaagcttgactggtgtctaggcttgatcccttcggctcggacatgattacatttacttaatggatcgcatatacatatctattgtttcataacttgagtgtaattctattgtcaccactttttaccactgtcaattaatggtgggtagtctactcaatgggtagatcaagtttttttagccttcaaatctccttatc

SEQ ID NO: 1753 - DNA, 200 bp, Kochia scoparia
gcctagacaccagtcaagcttgggttggtaaaatggtgaagtacttcgtatgtattgaagtattgtaagtacatgagtaaccgcaaaggctctaaagctactactactactactcctaattgggtaaccgcaatatgtgtggacagttcgaaagccacacaatttgagtggcattttccatttttcaattctcctctctc

SEQ ID NO: 1754 - DNA, 200 bp, Kochia scoparia
gagagaggagaattgaaaaatggaaaatgccactcaaattgtgtggctttcgaactgtccacacatattgcggttacccaattaggagtagtagtagtagtagctttagagcctttgcggttactcatgtacttacaatacttcaatacatacgaagtacttcaccattttaccaacccaagcttgactggtgtctaggc

SEQ ID NO: 1755 - DNA, 200 bp, Kochia scoparia
ttccatttttcaattctcctctctctctctctcagtggctcaaacagaaatcgcattacacccacattccacaaatggccctttgataaagcactaaacctactctactcctacactccttcatctaatctcaatttccgttacttctttggttctattgcacacccttttacacccattgcagtttatattccactgaa

SEQ ID NO: 1756 - DNA, 200 bp, Kochia scoparia
ttcagtggaatataaactgcaatgggtgtaaaagggtgtgcaatagaaccaaagaagtaacggaaattgagattagatgaaggagtgtaggagtagagtaggtttagtgctttatcaaagggccatttgtggaatgtgggtgtaatgcgatttctgtttgagccactgagagagagagagaggagaattgaaaaatggaa

SEQ ID NO: 1757 - DNA, 200 bp, Kochia scoparia
ccattgcagtttatattccactgaatttcgtattgcaaacccaatttacaaaaattgcagaagaaaatgagttattttggatatgcttgtgctacccaatccacttcaagatgtgttcttttgggcaattctggtaaccccacttcagtttcatctcgtggcagtgatttcatgggtcattctgtaagaaatttcagttt

SEQ ID NO: 1758 - DNA, 200 bp, Kochia scoparia
aaactgaaatttcttacagaatgacccatgaaatcactgccacgagatgaaactgaagtggggttaccagaattgcccaaaagaacacatcttgaagtggattgggtagcacaagcatatccaaaataactcattttcttctgcaatttttgtaaattgggtttgcaatacgaaattcagtggaatataaactgcaatgg

SEQ ID NO: 1759 - DNA, 200 bp, Kochia scoparia
gtcattctgtaagaaatttcagttttagcaaaagacagagaattgggcactgcccattgaaggttctattgcttgctttcttgtttatggatcaattttatgggatttgatgaaaagattagattttgtttatagttgaattaatcgagaattttaatgtatgatgcaggttgtttgtgtagattatccaagaccagagc

SEQ ID NO: 1760 - DNA, 200 bp, Kochia scoparia
gctctggtcttggataatctacacaaacaacctgcatcatacattaaaattctcgattaattcaactataaacaaaatctaatcttttcatcaaatcccataaaattgatccataaacaagaaagcaagcaatagaaccttcaatgggcagtgcccaattctctgtcttttgctaaaactgaaatttcttacagaatgac

SEQ ID NO: 1761 - DNA, 200 bp, Kochia scoparia
tgtgtagattatccaagaccagagcttgaaggtacagtcaattacttggaagctgcttatttatcttcaacttttcggaattcacctcgtcctcaaaagccgttagaggttgtaattgccggtgcaggtaagtgggatgtttcctgtaacttgctttgttcattagtttcttgttcttttgcttgttgctttataaacta

SEQ ID NO: 1762 - DNA, 200 bp, Kochia scoparia
tagtttataaagcaacaagcaaaagaacaagaaactaatgaacaaagcaagttacaggaaacatcccacttacctgcaccggcaattacaacctctaacggcttttgaggacgaggtgaattccgaaaagttgaagataaataagcagcttccaagtaattgactgtaccttcaagctctggtcttggataatctacaca

SEQ ID NO: 1763 - DNA, 200 bp, Kochia scoparia
cttttgcttgttgctttataaactagtgatgtttggtatgtgtttggtgtaatcattgtcttactgatatggaaaggattatgtaggagggaaaagggtagtgataattactgggtgtttggctaaggatgttcagcatagcatggttgtctcttacaaccacactcatgtattaccatggtaagggttgtacttagaaa

SEQ ID NO: 1764 - DNA, 200 bp, Kochia scoparia
tttctaagtacaacccttaccatggtaatacatgagtgtggttgtaagagacaaccatgctatgctgaacatccttagccaaacacccagtaattatcactacccttttccctcctacataatcctttccatatcagtaagacaatgattacaccaaacacataccaaacatcactagtttataaagcaacaagcaaaag

SEQ ID NO: 1765 - DNA, 200 bp, Kochia scoparia
ccatggtaagggttgtacttagaaaattgttgtatttggcaattggcaatacaatggaattgaaccatatttcatgaaggaccccctttggagagggtaaggtggttttaattgtatccataggttttcaaagggtgacaagtggagggaaatggttaccttcaggaaatgaggtttgttcctacacttacaccaaatgg

SEQ ID NO: 1766 - DNA, 200 bp, Kochia scoparia
ccatttggtgtaagtgtaggaacaaacctcatttcctgaaggtaaccatttccctccacttgtcaccctttgaaaacctatggatacaattaaaaccaccttaccctctccaaagggggtccttcatgaaatatggttcaattccattgtattgccaattgccaaatacaacaattttctaagtacaacccttaccatgg

SEQ ID NO: 1767 - DNA, 200 bp, Kochia scoparia
ttgttcctacacttacaccaaatggtgtgcaattacaccttaaaatccattaccaaacacccttaggtttcggtttatcatctgttagaggcctaccaatgagaatttcccttacgttaatgaagtaatgggttttgacaccttttttttttatgttgcatgttcgaaataagctttgtagtttgaagtagcttacggct

SEQ ID NO: 1768 - DNA, 200 bp, Kochia scoparia
agccgtaagctacttcaaactacaaagcttatttcgaacatgcaacataaaaaaaaaaggtgtcaaaacccattacttcattaacgtaagggaaattctcattggtaggcctctaacagatgataaaccgaaacctaagggtgtttggtaatggattttaaggtgtaattgcacaccatttggtgtaagtgtaggaacaa

SEQ ID NO: 1769 - DNA, 200 bp, Kochia scoparia
ttgtagtttgaagtagcttacggctaatagctgttatgcgggaatattgtgaattggaaaaagaataagagagtacttgcttcaaggatcataaggtttatgattgttggaatcatctttagtgaaattttgattttcaactgatctctacggtaactattggtccttcaaaattctagacgcagaatcgtttaggtgag

SEQ ID NO: 1770 - DNA, 200 bp, Kochia scoparia
ctcacctaaacgattctgcgtctagaattttgaaggaccaatagttaccgtagagatcagttgaaaatcaaaatttcactaaagatgattccaacaatcataaaccttatgatccttgaagcaagtactctcttattctttttccaattcacaatattcccgcataacagctattagccgtaagctacttcaaactacaa

SEQ ID NO: 1771 - DNA, 200 bp, Kochia scoparia
ctagacgcagaatcgtttaggtgagggtgaactctgattatgaatagtcaatgtctctcccaacgtgaaacttattagttctagctgttatgtgctccaattcgaggaacatcgtgaattggagaaagaatactgcttcaaggatcatgagtttatgattgtcgtaaacttctcttagttctttagtgaaatttcagcag

SEQ ID NO: 1772 - DNA, 200 bp, Kochia scoparia
ctgctgaaatttcactaaagaactaagagaagtttacgacaatcataaactcatgatccttgaagcagtattctttctccaattcacgatgttcctcgaattggagcacataacagctagaactaataagtttcacgttgggagagacattgactattcataatcagagttcaccctcacctaaacgattctgcgtctag

SEQ ID NO: 1773 - DNA, 200 bp, Kochia scoparia
tagttctttagtgaaatttcagcagattttaatggtaattagcagtccttcaaaatcctagatgcggaatcatctagggcatgtatatggtaaactctcatgatagataactagtgtctcctccatgtaaactttattaggtattttctttgtcaaaaagagtatttttcattggaaaaacaatataatggtgactactg

SEQ ID NO: 1774 - DNA, 200 bp, Kochia scoparia
cagtagtcaccattatattgtttttccaatgaaaaatactctttttgacaaagaaaatacctaataaagtttacatggaggagacactagttatctatcatgagagtttaccatatacatgccctagatgattccgcatctaggattttgaaggactgctaattaccattaaaatctgctgaaatttcactaaagaacta

SEQ ID NO: 1775 - DNA, 200 bp, Kochia scoparia
aaaaacaatataatggtgactactgcatatgtttggttagctattcctgttgcaaatcagattttgaatggaacatgtcttattcccttctagagctctcctggtgcaattctagcattttcccctcaataagtggtatttgagctaatatttcaagtctagacattatagcatgctataatgaggcggaattgtttgag

SEQ ID NO: 1776 - DNA, 200 bp, Kochia scoparia
ctcaaacaattccgcctcattatagcatgctataatgtctagacttgaaatattagctcaaataccacttattgaggggaaaatgctagaattgcaccaggagagctctagaagggaataagacatgttccattcaaaatctgatttgcaacaggaatagctaaccaaacatatgcagtagtcaccattatattgttttt

SEQ ID NO: 1777 - DNA, 200 bp, Kochia scoparia
ctataatgaggcggaattgtttgagccatgttaaagggttccatgacatgtaatatgctagtttatggcagggaacagggagttgggtccttgccttcatgggaaaagagagattgttaggtatttcttaagtttgcatgggaaagagttcttttatctttatagtgaaagttgactagtatgcaagtatggtggtggat

SEQ ID NO: 1778 - DNA, 200 bp, Kochia scoparia
atccaccaccatacttgcatactagtcaactttcactataaagataaaagaactctttcccatgcaaacttaagaaatacctaacaatctctcttttcccatgaaggcaaggacccaactccctgttccctgccataaactagcatattacatgtcatggaaccctttaacatggctcaaacaattccgcctcattatag

SEQ ID NO: 1779 - DNA, 200 bp, Kochia scoparia
ctagtatgcaagtatggtggtggattacccttattgccatttggacttgtatgctatttagtgcatatacttcagcctagcttaatcttgacaaaaatgccttgagttctagtggtttgctttattcattggttgatttgctatttctgctagtgaaattagagagaaaattgatgcctgtttcagtgtttctcatcaag

SEQ ID NO: 1780 - DNA, 200 bp, Kochia scoparia
cttgatgagaaacactgaaacaggcatcaattttctctctaatttcactagcagaaatagcaaatcaaccaatgaataaagcaaaccactagaactcaaggcatttttgtcaagattaagctaggctgaagtatatgcactaaatagcatacaagtccaaatggcaataagggtaatccaccaccatacttgcatactag

SEQ ID NO: 1781 - DNA, 200 bp, Kochia scoparia
gcctgtttcagtgtttctcatcaaggtaaatggacaaaactgtctatgtcttgaaattttctgtgaatactcaagcaggcttccttggtttgcttcaggctgattttcattgcctcagtttctgcttgttggtatcagaataaaaatagatacttttatgtatttgtgagagatttgttggtagaaccacatttattctg

SEQ ID NO: 1782 - DNA, 200 bp, Kochia scoparia
cagaataaatgtggttctaccaacaaatctctcacaaatacataaaagtatctatttttattctgataccaacaagcagaaactgaggcaatgaaaatcagcctgaagcaaaccaaggaagcctgcttgagtattcacagaaaatttcaagacatagacagttttgtccatttaccttgatgagaaacactgaaacaggc

SEQ ID NO: 1783 - DNA, 200 bp, Kochia scoparia
tgttggtagaaccacatttattctgagaaatatttgtacaaatgggagtttaaggttataagtgtgtaagccttttgaggtattttgttttaaaaatcttatcgttatttcagagcagcaagttacatatagtaaacttgggagcattggagatgtgatggaattagattcaatatattttatcatcaagatatgagttc

SEQ ID NO: 1784 - DNA, 200 bp, Kochia scoparia
gaactcatatcttgatgataaaatatattgaatctaattccatcacatctccaatgctcccaagtttactatatgtaacttgctgctctgaaataacgataagatttttaaaacaaaatacctcaaaaggcttacacacttataaccttaaactcccatttgtacaaatatttctcagaataaatgtggttctaccaaca

SEQ ID NO: 1785 - DNA, 200 bp, Kochia scoparia
tattttatcatcaagatatgagttctaattcaaaactttccttctaggtttggctggtctatccacagcgaagtacttggcagatgcaggacacaaacccatattgcttgaggcacgagatgttttgggtggaaaggtatgtgcttatatgctattttttcagaaatatatcctttgtgcttcttctcttctcagtttat

SEQ ID NO: 1786 - DNA, 200 bp, Kochia scoparia
ataaactgagaagagaagaagcacaaaggatatatttctgaaaaaatagcatataagcacatacctttccacccaaaacatctcgtgcctcaagcaatatgggtttgtgtcctgcatctgccaagtacttcgctgtggatagaccagccaaacctagaaggaaagttttgaattagaactcatatcttgatgataaaata

SEQ ID NO: 1787 - DNA, 200 bp, Kochia scoparia
tgtgcttcttctcttctcagtttatgttgactataataaatgaaacagcttaattgtcttggttgtatgctttcatagtattatctaggctacatggttatacggacatatattattgagtggagtgatttagtcatcttaagtggttatttacttttattttatagctgttgaagttattcatcattctgtacaatgtt

SEQ ID NO: 1788 - DNA, 200 bp, Kochia scoparia
aacattgtacagaatgatgaataacttcaacagctataaaataaaagtaaataaccacttaagatgactaaatcactccactcaataatatatgtccgtataaccatgtagcctagataatactatgaaagcatacaaccaagacaattaagctgtttcatttattatagtcaacataaactgagaagagaagaagcaca

SEQ ID NO: 1789 - DNA, 200 bp, Kochia scoparia
gttattcatcattctgtacaatgttaagtcagtgttaatgaggtttagagggtaatggactaatagacaagctttgtgctgtgaacggtttgagaacatgtgctattgggactgatgttatgcaatgtttgtggtagtcttccttcttatgcatttgtttattgttactgtttcacagggttgcagcgtggaaagatgag

SEQ ID NO: 1790 - DNA, 200 bp, Kochia scoparia
ctcatctttccacgctgcaaccctgtgaaacagtaacaataaacaaatgcataagaaggaagactaccacaaacattgcataacatcagtcccaatagcacatgttctcaaaccgttcacagcacaaagcttgtctattagtccattaccctctaaacctcattaacactgacttaacattgtacagaatgatgaataac

SEQ ID NO: 1791 - DNA, 200 bp, Kochia scoparia
cagggttgcagcgtggaaagatgaggatggtgactggtatgaaactgggctccatatattctgtgagtataatattttgcttttcagcttagatatcctgtttaagcttctagtcctacaatttatgttttctgctgagtggatttttgtaaaagttttacgggatctgtgcaatttctgccttctgattctgttattat

SEQ ID NO: 1792 - DNA, 200 bp, Kochia scoparia
ataataacagaatcagaaggcagaaattgcacagatcccgtaaaacttttacaaaaatccactcagcagaaaacataaattgtaggactagaagcttaaacaggatatctaagctgaaaagcaaaatattatactcacagaatatatggagcccagtttcataccagtcaccatcctcatctttccacgctgcaaccctg

SEQ ID NO: 1793 - DNA, 200 bp, Kochia scoparia
ttctgccttctgattctgttattatttggaagggcgtgatattgtgacaatttcaaagtggtttcactccagacaaaagtcaaactaacaattcaatgtactgaatacccttttattttcttgaagttggggcttatccaaatgtgcagaacttgtttggagaacttggtatcaatgaccgattgcaatggaaggaacat

SEQ ID NO: 1794 - DNA, 200 bp, Kochia scoparia
atgttccttccattgcaatcggtcattgataccaagttctccaaacaagttctgcacatttggataagccccaacttcaagaaaataaaagggtattcagtacattgaattgttagtttgacttttgtctggagtgaaaccactttgaaattgtcacaatatcacgcccttccaaataataacagaatcagaaggcagaa

SEQ ID NO: 1795 - DNA, 200 bp, Kochia scoparia
tgaccgattgcaatggaaggaacattctatgatttttgcaaggcctgacaaaccgggtgaatttagccgctttgattttcctgaagccctgcctgcacctttaaatggtgagtatttgacaccttatattctttagcaaactaagtattgtataagccaaactgcacctggtgacattcattgatttctttcttgctcac

SEQ ID NO: 1796 - DNA, 200 bp, Kochia scoparia
gtgagcaagaaagaaatcaatgaatgtcaccaggtgcagtttggcttatacaatacttagtttgctaaagaatataaggtgtcaaatactcaccatttaaaggtgcaggcagggcttcaggaaaatcaaagcggctaaattcacccggtttgtcaggccttgcaaaaatcatagaatgttccttccattgcaatcggtca

SEQ ID NO: 1797 - DNA, 200 bp, Kochia scoparia
attcattgatttctttcttgctcaccgactttccttgagattctagcaacatcttattctccgtcttctaatgagtaaactagttttgattctgttcattcttaatgtgtttggcaggcatatgggcaatcttaaggaataatgaaatgctaacatggccagagaaaatcaagtttgctattggtctcttacctgctatg

SEQ ID NO: 1798 - DNA, 200 bp, Kochia scoparia
catagcaggtaagagaccaatagcaaacttgattttctctggccatgttagcatttcattattccttaagattgcccatatgcctgccaaacacattaagaatgaacagaatcaaaactagtttactcattagaagacggagaataagatgttgctagaatctcaaggaaagtcggtgagcaagaaagaaatcaatgaat

SEQ ID NO: 1799 - DNA, 200 bp, Kochia scoparia
tgctattggtctcttacctgctatggctggtggacagtcctatgtcgaggcacaagatggtttaagtgttcaagagtggatgaaaaaacaagtaggaacaaacgatcatttttaaaaccttatttttcaaattccttgatgattgtctagattgttagttcattacatgtctaactttaaacattgatgttacagggaca

SEQ ID NO: 1800 - DNA, 200 bp, Kochia scoparia
tgtccctgtaacatcaatgtttaaagttagacatgtaatgaactaacaatctagacaatcatcaaggaatttgaaaaataaggttttaaaaatgatcgtttgttcctacttgttttttcatccactcttgaacacttaaaccatcttgtgcctcgacataggactgtccaccagccatagcaggtaagagaccaatagca

SEQ ID NO: 1801 - DNA, 200 bp, Kochia scoparia
tttaaacattgatgttacagggacatctattttatttatttttgaaaattccttttgcaaattttgtagggtgtgcctgatcgtgttacagatgaagtattcattgccatgtcaaaggcacttaacttcataaatccggatgaactttcgatgcagtgtatcttgattgctctgaatcgatttcttcaggtatagcccca

SEQ ID NO: 1802 - DNA, 200 bp, Kochia scoparia
tggggctatacctgaagaaatcgattcagagcaatcaagatacactgcatcgaaagttcatccggatttatgaagttaagtgcctttgacatggcaatgaatacttcatctgtaacacgatcaggcacaccctacaaaatttgcaaaaggaattttcaaaaataaataaaatagatgtccctgtaacatcaatgtttaaa

SEQ ID NO: 1803 - DNA, 200 bp, Kochia scoparia
atcgatttcttcaggtatagccccatttcactatctgctttaagtgtgttttattttcaattgaattcgacctgctcaactatatggaacttaagtaattttgatttgaacttattgatacaaacgtatcaaaacttacgataatctttttcagtttgatacactatcgttttgtttctgagaactttttgtaaattgga

SEQ ID NO: 1804 - DNA, 200 bp, Kochia scoparia
tccaatttacaaaaagttctcagaaacaaaacgatagtgtatcaaactgaaaaagattatcgtaagttttgatacgtttgtatcaataagttcaaatcaaaattacttaagttccatatagttgagcaggtcgaattcaattgaaaataaaacacacttaaagcagatagtgaaatggggctatacctgaagaaatcgat

SEQ ID NO: 1805 - DNA, 200 bp, Kochia scoparia
ttctgagaactttttgtaaattggattatatgtgatgttaaaattatggaattcactcaacaggaaaagcatggttcaaaaatggctttcttggatggaaatcctccagaaaggttatgcatgcctattgttgagcatattgagtcactaggtggtgaagtgcagcttaactctcgtattcaaaagataaagttaactca

SEQ ID NO: 1806 - DNA, 200 bp, Kochia scoparia
tgagttaactttatcttttgaatacgagagttaagctgcacttcaccacctagtgactcaatatgctcaacaataggcatgcataacctttctggaggatttccatccaagaaagccatttttgaaccatgcttttcctgttgagtgaattccataattttaacatcacatataatccaatttacaaaaagttctcagaa

SEQ ID NO: 1807 - DNA, 200 bp, Kochia scoparia
gtattcaaaagataaagttaactcaagatggaagtgtggatagcttcttgctaaccaatgggaaagaagttagaggggatgcttacgtctttgctactccaggtttacttttcttctttaccgaatgggattattattcaactaggaaattattgccatttttagtcaagacaggctcctgaagaaattatttattgcca

SEQ ID NO: 1808 - DNA, 200 bp, Kochia scoparia
tggcaataaataatttcttcaggagcctgtcttgactaaaaatggcaataatttcctagttgaataataatcccattcggtaaagaagaaaagtaaacctggagtagcaaagacgtaagcatcccctctaacttctttcccattggttagcaagaagctatccacacttccatcttgagttaactttatcttttgaatac

SEQ ID NO: 1809 - DNA, 200 bp, Kochia scoparia
ctcctgaagaaattatttattgccatctgtattgttctctgatatacctttaaatttttattacagttgacatcctaaagctacttcttcctgaagagtggaaagaaatttcatacttcaaaaagttggagaaactagtaggagttcctgtcattaatgttcacatatggttagtgatacctcttgtctacaggaatata

SEQ ID NO: 1810 - DNA, 200 bp, Kochia scoparia
tatattcctgtagacaagaggtatcactaaccatatgtgaacattaatgacaggaactcctactagtttctccaactttttgaagtatgaaatttctttccactcttcaggaagaagtagctttaggatgtcaactgtaataaaaatttaaaggtatatcagagaacaatacagatggcaataaataatttcttcaggag

SEQ ID NO: 1811 - DNA, 200 bp, Kochia scoparia
gatacctcttgtctacaggaatatagtttcttaatgctataacccaatcttatgtgtcttctcttactctatgtaattttatttatgtatctatctttctctttccatgtccatgtattttgttatttctgtctttggctttttagaatggtttgtcagtatatctttgcaattaggctctgatttaatagcctactact

SEQ ID NO: 1812 - DNA, 200 bp, Kochia scoparia
agtagtaggctattaaatcagagcctaattgcaaagatatactgacaaaccattctaaaaagccaaagacagaaataacaaaatacatggacatggaaagagaaagatagatacataaataaaattacatagagtaagagaagacacataagattgggttatagcattaagaaactatattcctgtagacaagaggtatc

SEQ ID NO: 1813 - DNA, 200 bp, Kochia scoparia
ggctctgatttaatagcctactactatacgaagtatatcatttctttggtagtatattttctgtagtttgcgttgagagtttgagactcctatacgtagagcttcatcttaataaaattttatgtcttgtaaaatctgtctgttttgaaatgtcaaaaaagctgtcaaaagctatttctcaccctctccttatgaagaac

SEQ ID NO: 1814 - DNA, 200 bp, Kochia scoparia
gttcttcataaggagagggtgagaaatagcttttgacagcttttttgacatttcaaaacagacagattttacaagacataaaattttattaagatgaagctctacgtataggagtctcaaactctcaacgcaaactacagaaaatatactaccaaagaaatgatatacttcgtatagtagtaggctattaaatcagagcc

SEQ ID NO: 1815 - DNA, 200 bp, Kochia scoparia
ttctcaccctctccttatgaagaacttcaatgaaatctcctctaatattgggactgacatttaacaactgttggcttgcaggtttgataggaaattgaagaatacatatgaccacctactcttcagcaggtgtgttcaattaaagtgctaaattcaatatcattttcatagcactcaaacaatactcaaagattatcctt

SEQ ID NO: 1816 - DNA, 200 bp, Kochia scoparia
aaggataatctttgagtattgtttgagtgctatgaaaatgatattgaatttagcactttaattgaacacacctgctgaagagtaggtggtcatatgtattcttcaatttcctatcaaacctgcaagccaacagttgttaaatgtcagtcccaatattagaggagatttcattgaagttcttcataaggagagggtgagaa

SEQ ID NO: 1817 - DNA, 200 bp, Kochia scoparia
caaacaatactcaaagattatccttccctttttgtccttgttttatactcatttcgttttccctttttttgttggaaagcacattttgttgagcatatgccatgagctgcatacttgcataaaattgggcaaaggagccacagtcatttgatatgaagtatgatttaagaatcctcctatgaagttagaaaagttatggt

SEQ ID NO: 1818 - DNA, 200 bp, Kochia scoparia
accataacttttctaacttcataggaggattcttaaatcatacttcatatcaaatgactgtggctcctttgcccaattttatgcaagtatgcagctcatggcatatgctcaacaaaatgtgctttccaacaaaaaaagggaaaacgaaatgagtataaaacaaggacaaaaagggaaggataatctttgagtattgtttg

SEQ ID NO: 1819 - DNA, 200 bp, Kochia scoparia
cctatgaagttagaaaagttatggtactagttttcttttactgagtgaacggggtatccctgccagcaatgtgtacaaggatactggcttgctgcagaaagatactttcagtattgataagatacaaattgcatttttcttttggatgaaatacagtgaactggcaatggtgtcagcttgaacgttgagaatccttgata

SEQ ID NO: 1820 - DNA, 200 bp, Kochia scoparia
tatcaaggattctcaacgttcaagctgacaccattgccagttcactgtatttcatccaaaagaaaaatgcaatttgtatcttatcaatactgaaagtatctttctgcagcaagccagtatccttgtacacattgctggcagggataccccgttcactcagtaaaagaaaactagtaccataacttttctaacttcatagg

SEQ ID NO: 1821 - DNA, 200 bp, Kochia scoparia
gcttgaacgttgagaatccttgatatccatttgattcatgttttcacttgtgcgtggatttcactcctataagtttgtcattgcaggagtcctcttttgagtgtctatgctgatatgtcagagacatgcaaggtaatttctcctcaattttgttcttcatcatgtaatacatgctgtctcattcgcaaacgtctactatg

SEQ ID NO: 1822 - DNA, 200 bp, Kochia scoparia
catagtagacgtttgcgaatgagacagcatgtattacatgatgaagaacaaaattgaggagaaattaccttgcatgtctctgacatatcagcatagacactcaaaagaggactcctgcaatgacaaacttataggagtgaaatccacgcacaagtgaaaacatgaatcaaatggatatcaaggattctcaacgttcaagc

SEQ ID NO: 1823 - DNA, 200 bp, Kochia scoparia
gtctcattcgcaaacgtctactatgtgctattcaatcgaaggcatatgtaatgttatttaatcaaaagcatatactgtatataagtgctttgtcacttccaaaactatgtctgttttttaatcccctatcgatttttttatttgttatttatttcttaattgttttgttagcttgttatatgtttgtctttgagactttt

SEQ ID NO: 1824 - DNA, 200 bp, Kochia scoparia
aaaagtctcaaagacaaacatataacaagctaacaaaacaattaagaaataaataacaaataaaaaaatcgataggggattaaaaaacagacatagttttggaagtgacaaagcacttatatacagtatatgcttttgattaaataacattacatatgccttcgattgaatagcacatagtagacgtttgcgaatgagac

SEQ ID NO: 1825 - DNA, 200 bp, Kochia scoparia
ttatatgtttgtctttgagactttttggttgttatcattgaacatctttatgacttactcctttcggaatcaagttacacatacaatgaaagtgtgtatgattaaatttgtcaataggctattatttgtttgagtgatgaggagatgataactttattcctactataaagaaaaggtctactttaaaacctcgtcttgtc

SEQ ID NO: 1826 - DNA, 200 bp, Kochia scoparia
gacaagacgaggttttaaagtagaccttttctttatagtaggaataaagttatcatctcctcatcactcaaacaaataatagcctattgacaaatttaatcatacacactttcattgtatgtgtaacttgattccgaaaggagtaagtcataaagatgttcaatgataacaaccaaaaagtctcaaagacaaacatataa

SEQ ID NO: 1827 - DNA, 200 bp, Kochia scoparia
gtctactttaaaacctcgtcttgtcattaattatgagggttggatgttgggattgagataaatcaactgataccagaacccagaaggggaaaatgcagaaatactacctcatgagctgtggctgacctttctgttcccatgatcttgtcttattctatgagtatgaactaaagtagtagagtgttcccaatcttttggag

SEQ ID NO: 1828 - DNA, 200 bp, Kochia scoparia
ctccaaaagattgggaacactctactactttagttcatactcatagaataagacaagatcatgggaacagaaaggtcagccacagctcatgaggtagtatttctgcattttccccttctgggttctggtatcagttgatttatctcaatcccaacatccaaccctcataattaatgacaagacgaggttttaaagtagac

SEQ ID NO: 1829 - DNA, 200 bp, Kochia scoparia
gtagagtgttcccaatcttttggagcgtacaggaatattatgatccaaaccggtccatgctggaattggtttttgcacctgcagaagaatgggtttctcggagtgacacggacattattgaggcaacaatgaacgaacttgccaagctttttcctgatgaaatcgcagctgatgggagcaaggctaagatcctaaaatat

SEQ ID NO: 1830 - DNA, 200 bp, Kochia scoparia
atattttaggatcttagccttgctcccatcagctgcgatttcatcaggaaaaagcttggcaagttcgttcattgttgcctcaataatgtccgtgtcactccgagaaacccattcttctgcaggtgcaaaaaccaattccagcatggaccggtttggatcataatattcctgtacgctccaaaagattgggaacactctac

SEQ ID NO: 1831 - DNA, 200 bp, Kochia scoparia
gagcaaggctaagatcctaaaatatcatgtagtcaaaactcccaggtgagataatatgtactatactgctctgtattagttagatttggtaatcgtttgtggtattaagcagaccttatctgctgaaaagcagtatcgatatttactactgttaaggtctctaactgttaattcttccattccttcacaggtctgtttat

SEQ ID NO: 1832 - DNA, 200 bp, Kochia scoparia
ataaacagacctgtgaaggaatggaagaattaacagttagagaccttaacagtagtaaatatcgatactgcttttcagcagataaggtctgcttaataccacaaacgattaccaaatctaactaatacagagcagtatagtacatattatctcacctgggagttttgactacatgatattttaggatcttagccttgctc

SEQ ID NO: 1833 - DNA, 200 bp, Kochia scoparia
tccattccttcacaggtctgtttataagacagttccaaactgtgaaccttgtcgaccattgcaaaggtcaccaatagaaggtttctatttatccggtgattacacaaagcaaaaatatttggcttcaatggaaggtgctgtcctgtctgggaagttttgtgcacaggctattgtacaggtaatgaggttttgctcaaaca

SEQ ID NO: 1834 - DNA, 200 bp, Kochia scoparia
tgtttgagcaaaacctcattacctgtacaatagcctgtgcacaaaacttcccagacaggacagcaccttccattgaagccaaatatttttgctttgtgtaatcaccggataaatagaaaccttctattggtgacctttgcaatggtcgacaaggttcacagtttggaactgtcttataaacagacctgtgaaggaatgga

SEQ ID NO: 1835 - DNA, 200 bp, Kochia scoparia
caggtaatgaggttttgctcaaacatcataagcatgatattcatgagtttcacttcctatatctcctagaatcctcatgatattgttactctataaattatgtttactgaaaatttagtcctattattcatttgcaggattatgatatgcttgttgctcgagcacaaagagaattggcaggggcaggcaacgcctgattt

SEQ ID NO: 1836 - DNA, 200 bp, Kochia scoparia
aaatcaggcgttgcctgcccctgccaattctctttgtgctcgagcaacaagcatatcataatcctgcaaatgaataataggactaaattttcagtaaacataatttatagagtaacaatatcatgaggattctaggagatataggaagtgaaactcatgaatatcatgcttatgatgtttgagcaaaacctcattacctg

SEQ ID NO: 1837 - DNA, 200 bp, Kochia scoparia
ggcaggggcaggcaacgcctgatttgaaattctttgatatttgcccatttttttcgtcggagatttggattggtgatcttgttcagatcgagttcagatcgatattcaactactggaaacaaactctgggaagcattctcagttatactcaatttttttttctgctgttcaagatgtatatgtgtagcttaattgtaggg

SEQ ID NO: 1838 - DNA, 200 bp, Kochia scoparia
ccctacaattaagctacacatatacatcttgaacagcagaaaaaaaaattgagtataactgagaatgcttcccagagtttgtttccagtagttgaatatcgatctgaactcgatctgaacaagatcaccaatccaaatctccgacgaaaaaaatgggcaaatatcaaagaatttcaaatcaggcgttgcctgcccctgcc

SEQ ID NO: 1839 - DNA, 200 bp, Kochia scoparia
gtatatgtgtagcttaattgtagggaaacatgtacaggcatgtactcataagtggtttcaaatgtaagtagtaattcaatacatgtactaacatttctgtggaaataggaaactgttttagaagagtgtcccctttctacttcgtaaatgacatttagattgtggctttgttgctgggagcatggtccggcttggttagg

SEQ ID NO: 1840 - DNA, 200 bp, Kochia scoparia
cctaaccaagccggaccatgctcccagcaacaaagccacaatctaaatgtcatttacgaagtagaaaggggacactcttctaaaacagtttcctatttccacagaaatgttagtacatgtattgaattactacttacatttgaaaccacttatgagtacatgcctgtacatgtttccctacaattaagctacacatatac

SEQ ID NO: 1841 - DNA, 200 bp, Kochia scoparia
gggagcatggtccggcttggttaggaagcacgaggccattgcccgaatgccgccaatgtggattgatggatcttctcttagcttcttaaggggttagtctttttccatgatacttcctcagttattgaaagaatgtaaaccttttttttttttttcattttgtcgtgaaacttcgcaattttcaatcttatacgtgtatg

SEQ ID NO: 1842 - DNA, 200 bp, Kochia scoparia
catacacgtataagattgaaaattgcgaagtttcacgacaaaatgaaaaaaaaaaaaaaggtttacattctttcaataactgaggaagtatcatggaaaaagactaaccccttaagaagctaagagaagatccatcaatccacattggcggcattcgggcaatggcctcgtgcttcctaaccaagccggaccatgctccc

SEQ ID NO: 1843 - DNA, 200 bp, Kochia scoparia
caattttcaatcttatacgtgtatgaaacttcgatattacttctccatatttttaatcacaacacgtatggattgccggattggcaataaagttgatgatagagaaaatatgtgggggcatatgaaattcttgtgagagtaaagtggtggtcttgtataccattttaaaaacgtcgtaaacattttgaatcaactcaaaa

SEQ ID NO: 1844 - DNA, 200 bp, Kochia scoparia
ttttgagttgattcaaaatgtttacgacgtttttaaaatggtatacaagaccaccactttactctcacaagaatttcatatgcccccacatattttctctatcatcaactttattgccaatccggcaatccatacgtgttgtgattaaaaatatggagaagtaatatcgaagtttcatacacgtataagattgaaaattg

SEQ ID NO: 1845 - DNA, 200 bp, Kochia scoparia
gtaaacattttgaatcaactcaaaaatataaaaagtgtcccctttatacttcattcatttgcatttggacatccctttcaaatattgctaagcttagcttagcgattagggttgaaccttttaaccttgaggatgcaggttaaatttttactaaagcatttcggggtttttctattattactctttcccccctactttta

SEQ ID NO: 1846 - DNA, 200 bp, Kochia scoparia
taaaagtaggggggaaagagtaataatagaaaaaccccgaaatgctttagtaaaaatttaacctgcatcctcaaggttaaaaggttcaaccctaatcgctaagctaagcttagcaatatttgaaagggatgtccaaatgcaaatgaatgaagtataaaggggacactttttatatttttgagttgattcaaaatgtttac

SEQ ID NO: 1847 - DNA, 200 bp, Kochia scoparia
tattactctttcccccctacttttaaagcgtctagtcatcaaacttacagcggatcgatgtttgaatacgataacgttatcctacaaaaaagaagaaagggtacctcaaccccaattccccaagacctactcccaaagtccaaaacaacatgagtggatttgcaagttgcaaataggcattaggcatatattatttgggc

SEQ ID NO: 1848 - DNA, 200 bp, Kochia scoparia
gcccaaataatatatgcctaatgcctatttgcaacttgcaaatccactcatgttgttttggactttgggagtaggtcttggggaattggggttgaggtaccctttcttcttttttgtaggataacgttatcgtattcaaacatcgatccgctgtaagtttgatgactagacgctttaaaagtaggggggaaagagtaata

SEQ ID NO: 1849 - DNA, 200 bp, Kochia scoparia
ggcattaggcatatattatttgggcaaaatagtagtaattggagttgcgttgtgcattctttgaagattaactacttgagtgtgcgtgcagtcggtgccgtcagtaacaaactacatacacatcacatctcgagggatgaaccccccattaagctactctacaagaaccatgaacctccatggggacacccacactatgc

SEQ ID NO: 1850 - DNA, 200 bp, Kochia scoparia
gcatagtgtgggtgtccccatggaggttcatggttcttgtagagtagcttaatggggggttcatccctcgagatgtgatgtgtatgtagtttgttactgacggcaccgactgcacgcacactcaagtagttaatcttcaaagaatgcacaacgcaactccaattactactattttgcccaaataatatatgcctaatgcc

SEQ ID NO: 1851 - DNA, 200 bp, Kochia scoparia
ctccatggggacacccacactatgctactaagcaaaatccttaacatcctcgactagatatatacttcttccgtttctttttactgtaaatgcaacaaaagtatctttttgttttcacaaatgtcgatttggcttgtaaagcttgtgaattggctcgatttttatttttctttcgcaatttcataaaactcgttacactt

SEQ ID NO: 1852 - DNA, 200 bp, Kochia scoparia
aagtgtaacgagttttatgaaattgcgaaagaaaaataaaaatcgagccaattcacaagctttacaagccaaatcgacatttgtgaaaacaaaaagatacttttgttgcatttacagtaaaaagaaacggaagaagtatatatctagtcgaggatgttaaggattttgcttagtagcatagtgtgggtgtccccatggag

SEQ ID NO: 1853 - DNA, 200 bp, Kochia scoparia
caatttcataaaactcgttacacttttcattctaagatggtctcacattacttgttatacttttttttttttgtaataaactatttattatatatctcttctcacatgagtcctccttgcttttttattctctatctcctccctctccaaaaatcagtgaattgagaaatgtagcgagtaatatgaaacggaagaagtac

SEQ ID NO: 1854 - DNA, 200 bp, Kochia scoparia
gtacttcttccgtttcatattactcgctacatttctcaattcactgatttttggagagggaggagatagagaataaaaaagcaaggaggactcatgtgagaagagatatataataaatagtttattacaaaaaaaaaaaagtataacaagtaatgtgagaccatcttagaatgaaaagtgtaacgagttttatgaaattg

SEQ ID NO: 1855 - DNA, 200 bp, Kochia scoparia
gagtaatatgaaacggaagaagtactttggaaaacatttgtactatcaatacatacatgaaaacaatgatcctatctattacatatatgacaagattaagaaattcactgtctattaaaaccaacaaattgaatattaattgaagaagaaaagaaaaacataaaaactgaaggtaataatgtactgtataaaacttgttc

SEQ ID NO: 1856 - DNA, 200 bp, Kochia scoparia
gaacaagttttatacagtacattattaccttcagtttttatgtttttcttttcttcttcaattaatattcaatttgttggttttaatagacagtgaatttcttaatcttgtcatatatgtaatagataggatcattgttttcatgtatgtattgatagtacaaatgttttccaaagtacttcttccgtttcatattactc

SEQ ID NO: 1857 - DNA, 200 bp, Kochia scoparia
atgagtcattttggatatgcttgtgctacccaatccacttcaagatgtgttcttttgggcaattctggtaaccccacttcagtttcatctcgtggcagtgatttcatgggtcattctgtaagaaatttcagttttagcaaaagacagagaattgggcactgcccattgaaggttgtttgtgtagattatccaagaccaga

SEQ ID NO: 1858 - DNA, 200 bp, Kochia scoparia
tctggtcttggataatctacacaaacaaccttcaatgggcagtgcccaattctctgtcttttgctaaaactgaaatttcttacagaatgacccatgaaatcactgccacgagatgaaactgaagtggggttaccagaattgcccaaaagaacacatcttgaagtggattgggtagcacaagcatatccaaaatgactcat

SEQ ID NO: 1859 - DNA, 200 bp, Kochia scoparia
tttgtgtagattatccaagaccagagcttgaaggtacagtcaattacttggaagctgcttatttatcttcaacttttcggaattcacctcgtcctcaaaagccgttagaggttgtaattgccggtgcaggagggaaaagggtagtgataattactgggtgtttggctaaggatgttcagcatagcatggttgtctcttac

SEQ ID NO: 1860 - DNA, 200 bp, Kochia scoparia
gtaagagacaaccatgctatgctgaacatccttagccaaacacccagtaattatcactacccttttccctcctgcaccggcaattacaacctctaacggcttttgaggacgaggtgaattccgaaaagttgaagataaataagcagcttccaagtaattgactgtaccttcaagctctggtcttggataatctacacaaa

SEQ ID NO: 1861 - DNA, 200 bp, Kochia scoparia
tcagcatagcatggttgtctcttacaaccacactcatgtattaccatggaccccctttggagagggtaaggtggttttaattgtatccataggttttcaaagggtgacaagtggagggaaatggttaccttcaggaaatgagggaacagggagttgggtccttgccttcatgggaaaagagagattgttaggtttggctg

SEQ ID NO: 1862 - DNA, 200 bp, Kochia scoparia
cagccaaacctaacaatctctcttttcccatgaaggcaaggacccaactccctgttccctcatttcctgaaggtaaccatttccctccacttgtcaccctttgaaaacctatggatacaattaaaaccaccttaccctctccaaagggggtccatggtaatacatgagtgtggttgtaagagacaaccatgctatgctga

SEQ ID NO: 1863 - DNA, 200 bp, Kochia scoparia
aaagagagattgttaggtttggctggtctatccacagcgaagtacttggcagatgcaggacacaaacccatattgcttgaggcacgagatgttttgggtggaaagctgttgaagttattcatcattctgtacaatgttaagtcagtgttaatgaggtttagagggttgcagcgtggaaagatgaggatggtgactggtat

SEQ ID NO: 1864 - DNA, 200 bp, Kochia scoparia
ataccagtcaccatcctcatctttccacgctgcaaccctctaaacctcattaacactgacttaacattgtacagaatgatgaataacttcaacagctttccacccaaaacatctcgtgcctcaagcaatatgggtttgtgtcctgcatctgccaagtacttcgctgtggatagaccagccaaacctaacaatctctcttt

SEQ ID NO: 1865 - DNA, 200 bp, Kochia scoparia
gaaagatgaggatggtgactggtatgaaactgggctccatatattctaacttgtttggagaacttggtatcaatgaccgattgcaatggaaggaacattctatgatttttgcaaggcctgacaaaccgggtgaatttagccgctttgattttcctgaagccctgcctgcacctttaaatggcatatgggcaatcttaagg

SEQ ID NO: 1866 - DNA, 200 bp, Kochia scoparia
ccttaagattgcccatatgccatttaaaggtgcaggcagggcttcaggaaaatcaaagcggctaaattcacccggtttgtcaggccttgcaaaaatcatagaatgttccttccattgcaatcggtcattgataccaagttctccaaacaagttagaatatatggagcccagtttcataccagtcaccatcctcatctttc

SEQ ID NO: 1867 - DNA, 200 bp, Kochia scoparia
aaatggcatatgggcaatcttaaggaataatgaaatgctaacatggccagagaaaatcaagtttgctattggtctcttacctgctatggctggtggacagtcctatgtcgaggcacaagatggtttaagtgttcaagagtggatgaaaaaacaaggtgtgcctgatcgtgttacagatgaagtattcattgccatgtcaa

SEQ ID NO: 1868 - DNA, 200 bp, Kochia scoparia
ttgacatggcaatgaatacttcatctgtaacacgatcaggcacaccttgttttttcatccactcttgaacacttaaaccatcttgtgcctcgacataggactgtccaccagccatagcaggtaagagaccaatagcaaacttgattttctctggccatgttagcatttcattattccttaagattgcccatatgccattt

SEQ ID NO: 1869 - DNA, 200 bp, Kochia scoparia
gatgaagtattcattgccatgtcaaaggcacttaacttcataaatccggatgaactttcgatgcagtgtatcttgattgctctgaatcgatttcttcaggaaaagcatggttcaaaaatggctttcttggatggaaatcctccagaaaggttatgcatgcctattgttgagcatattgagtcactaggtggtgaagtgca

SEQ ID NO: 1870 - DNA, 200 bp, Kochia scoparia
tgcacttcaccacctagtgactcaatatgctcaacaataggcatgcataacctttctggaggatttccatccaagaaagccatttttgaaccatgcttttcctgaagaaatcgattcagagcaatcaagatacactgcatcgaaagttcatccggatttatgaagttaagtgcctttgacatggcaatgaatacttcatc

SEQ ID NO: 1871 - DNA, 200 bp, Kochia scoparia
ttgagtcactaggtggtgaagtgcagcttaactctcgtattcaaaagataaagttaactcaagatggaagtgtggatagcttcttgctaaccaatgggaaagaagttagaggggatgcttacgtctttgctactccagttgacatcctaaagctacttcttcctgaagagtggaaagaaatttcatacttcaaaaagttg

SEQ ID NO: 1872 - DNA, 200 bp, Kochia scoparia
caactttttgaagtatgaaatttctttccactcttcaggaagaagtagctttaggatgtcaactggagtagcaaagacgtaagcatcccctctaacttctttcccattggttagcaagaagctatccacacttccatcttgagttaactttatcttttgaatacgagagttaagctgcacttcaccacctagtgactcaa

SEQ ID NO: 1873 - DNA, 200 bp, Kochia scoparia
agaaatttcatacttcaaaaagttggagaaactagtaggagttcctgtcattaatgttcacatatggtttgataggaaattgaagaatacatatgaccacctactcttcagcaggagtcctcttttgagtgtctatgctgatatgtcagagacatgcaaggaatattatgatccaaaccggtccatgctggaattggttt

SEQ ID NO: 1874 - DNA, 200 bp, Kochia scoparia
aaaccaattccagcatggaccggtttggatcataatattccttgcatgtctctgacatatcagcatagacactcaaaagaggactcctgctgaagagtaggtggtcatatgtattcttcaatttcctatcaaaccatatgtgaacattaatgacaggaactcctactagtttctccaactttttgaagtatgaaatttct

SEQ ID NO: 1875 - DNA, 200 bp, Kochia scoparia
aaccggtccatgctggaattggtttttgcacctgcagaagaatgggtttctcggagtgacacggacattattgaggcaacaatgaacgaacttgccaagctttttcctgatgaaatcgcagctgatgggagcaaggctaagatcctaaaatatcatgtagtcaaaactcccaggtctgtttataagacagttccaaactg

SEQ ID NO: 1876 - DNA, 200 bp, Kochia scoparia
cagtttggaactgtcttataaacagacctgggagttttgactacatgatattttaggatcttagccttgctcccatcagctgcgatttcatcaggaaaaagcttggcaagttcgttcattgttgcctcaataatgtccgtgtcactccgagaaacccattcttctgcaggtgcaaaaaccaattccagcatggaccggtt

SEQ ID NO: 1877 - DNA, 200 bp, Kochia scoparia
ctgtttataagacagttccaaactgtgaaccttgtcgaccattgcaaaggtcaccaatagaaggtttctatttatccggtgattacacaaagcaaaaatatttggcttcaatggaaggtgctgtcctgtctgggaagttttgtgcacaggctattgtacaggattatgatatgcttgttgctcgagcacaaagagaattg

SEQ ID NO: 1878 - DNA, 200 bp, Kochia scoparia
caattctctttgtgctcgagcaacaagcatatcataatcctgtacaatagcctgtgcacaaaacttcccagacaggacagcaccttccattgaagccaaatatttttgctttgtgtaatcaccggataaatagaaaccttctattggtgacctttgcaatggtcgacaaggttcacagtttggaactgtcttataaacag

SEQ ID NO: 1879 - DNA, 200 bp, Kochia scoparia
atgagttattttggatatgcttgtgctacccaatccacttcaagatgtgttcttttgggcaattctggtaaccccacttcagtttcatctcgtggcagtgatttcatgggtcattctgtaagaaatttcagttttagcaaaagacagagaattgggcactgcccattgaaggttgtttgtgtagattatccaagaccaga

SEQ ID NO: 1880 - DNA, 200 bp, Kochia scoparia
tctggtcttggataatctacacaaacaaccttcaatgggcagtgcccaattctctgtcttttgctaaaactgaaatttcttacagaatgacccatgaaatcactgccacgagatgaaactgaagtggggttaccagaattgcccaaaagaacacatcttgaagtggattgggtagcacaagcatatccaaaataactcat

SEQ ID NO: 1881 - DNA, 200 bp, Kochia scoparia; identical to SEQ ID NO: 1859

SEQ ID NO: 1882 - DNA, 200 bp, Kochia scoparia; identical to SEQ ID NO: 1860

SEQ ID NO: 1883 - DNA, 200 bp, Kochia scoparia; identical to SEQ ID NO: 1861

SEQ ID NO: 1884 - DNA, 200 bp, Kochia scoparia; identical to SEQ ID NO: 1862

SEQ ID NO: 1885 - DNA, 200 bp, Kochia scoparia
aaagagagattgttaggtttggctggtctatccacagcgaagtacttggcagatgcaggacacaaacccatattgcttgaggcacgagatgttttgggtggaaagctgttgaagttattcatcattctgtacaatgttaagtcagtgttaatgaggtttagaggggttgcagcgtggaaagatgaggatggtgactggta

SEQ ID NO: 1886 - DNA, 200 bp, Kochia scoparia
taccagtcaccatcctcatctttccacgctgcaacccctctaaacctcattaacactgacttaacattgtacagaatgatgaataacttcaacagctttccacccaaaacatctcgtgcctcaagcaatatgggtttgtgtcctgcatctgccaagtacttcgctgtggatagaccagccaaacctaacaatctctcttt

SEQ ID NO: 1887 - DNA, 200 bp, Kochia scoparia
ggaaagatgaggatggtgactggtatgaaactgggctccatatattctttggggcttatccaaatgtgcagaacttgtttggagaacttggtatcaatgaccgattgcaatggaaggaacattctatgatttttgcaaggcctgacaaaccgggtgaatttagccgctttgattttcctgaagccctgcctgcaccttta

SEQ ID NO: 1888 - DNA, 200 bp, Kochia scoparia
taaaggtgcaggcagggcttcaggaaaatcaaagcggctaaattcacccggtttgtcaggccttgcaaaaatcatagaatgttccttccattgcaatcggtcattgataccaagttctccaaacaagttctgcacatttggataagccccaaagaatatatggagcccagtttcataccagtcaccatcctcatctttcc

SEQ ID NO: 1889 - DNA, 200 bp, Kochia scoparia
tcctgaagccctgcctgcacctttaaatggcatatgggcaatcttaaggaataatgaaatgctaacatggccagagaaaatcaagtttgctattggtctcttacctgctatggctggtggacagtcctatgtcgaggcacaagatggtttaagtgttcaagagtggatgaaaaaacaaggtgtgcctgatcgtgttacag

SEQ ID NO: 1890 - DNA, 200 bp, Kochia scoparia
ctgtaacacgatcaggcacaccttgttttttcatccactcttgaacacttaaaccatcttgtgcctcgacataggactgtccaccagccatagcaggtaagagaccaatagcaaacttgattttctctggccatgttagcatttcattattccttaagattgcccatatgccatttaaaggtgcaggcagggcttcagga

SEQ ID NO: 1891 - DNA, 200 bp, Kochia scoparia
caaggtgtgcctgatcgtgttacagatgaagtattcattgccatgtcaaaggcacttaacttcataaatccggatgaactttcgatgcagtgtatcttgattgctctgaatcgatttcttcaggaaaagcatggttcaaaaatggctttcttggatggaaatcctccagaaaggttatgcatgcctattgttgagcatat

SEQ ID NO: 1892 - DNA, 200 bp, Kochia scoparia
atatgctcaacaataggcatgcataacctttctggaggatttccatccaagaaagccatttttgaaccatgcttttcctgaagaaatcgattcagagcaatcaagatacactgcatcgaaagttcatccggatttatgaagttaagtgcctttgacatggcaatgaatacttcatctgtaacacgatcaggcacaccttg

SEQ ID NO: 1893 - DNA, 200 bp, Kochia scoparia
tatgcatgcctattgttgagcatattgagtcactaggtggtgaagtgcagcttaactctcgtattcaaaagataaagttaactcaagatggaagtgtggatagcttcttgctaaccaatgggaaagaagttagaggggatgcttacgtctttgctactccagttgacatcctaaagctacttcttcctgaagagtggaaa

SEQ ID NO: 1894 - DNA, 200 bp, Kochia scoparia
tttccactcttcaggaagaagtagctttaggatgtcaactggagtagcaaagacgtaagcatcccctctaacttctttcccattggttagcaagaagctatccacacttccatcttgagttaactttatcttttgaatacgagagttaagctgcacttcaccacctagtgactcaatatgctcaacaataggcatgcata

SEQ ID NO: 1895 - DNA, 200 bp, Kochia scoparia
gctacttcttcctgaagagtggaaagaaatttcatacttcaaaaagttggagaaactagtaggagttcctgtcattaatgttcacatatggtttgataggaaattgaagaatacatatgaccacctactcttcagcaggagtcctcttttgagtgtctatgctgatatgtcagagacatgcaaggaatattatgatccaa

SEQ ID NO: 1896 - DNA, 200 bp, Kochia scoparia
ttggatcataatattccttgcatgtctctgacatatcagcatagacactcaaaagaggactcctgctgaagagtaggtggtcatatgtattcttcaatttcctatcaaaccatatgtgaacattaatgacaggaactcctactagtttctccaactttttgaagtatgaaatttctttccactcttcaggaagaagtagc

SEQ ID NO: 1897 - DNA, 200 bp, Kochia scoparia
acatgcaaggaatattatgatccaaaccggtccatgctggaattggtttttgcacctgcagaagaatgggtttctcggagtgacacggacattattgaggcaacaatgaacgaacttgccaagctttttcctgatgaaatcgcagctgatgggagcaaggctaagatcctaaaatatcatgtagtcaaaactcccaggtc

SEQ ID NO: 1898 - DNA, 200 bp, Kochia scoparia
gacctgggagttttgactacatgatattttaggatcttagccttgctcccatcagctgcgatttcatcaggaaaaagcttggcaagttcgttcattgttgcctcaataatgtccgtgtcactccgagaaacccattcttctgcaggtgcaaaaaccaattccagcatggaccggtttggatcataatattccttgcatgt

SEQ ID NO: 1899 - DNA, 200 bp, Kochia scoparia
atcatgtagtcaaaactcccaggtctgtttataagacagttccaaactgtgaaccttgtcgaccattgcaaaggtcaccaatagaaggtttctatttatccggtgattacacaaagcaaaaatatttggcttcaatggaaggtgctgtcctgtctgggaagttttgtgcacaggctattgtacaggattatgatatgctt

SEQ ID NO: 1900 - DNA, 200 bp, Kochia scoparia
aagcatatcataatcctgtacaatagcctgtgcacaaaacttcccagacaggacagcaccttccattgaagccaaatatttttgctttgtgtaatcaccggataaatagaaaccttctattggtgacctttgcaatggtcgacaaggttcacagtttggaactgtcttataaacagacctgggagttttgactacatgat

SEQ ID NO: 1901 - DNA, 200 bp, Lolium multiflorum
aactgaaccctgacgggaccgtgaagcactttgcattgagtgatgggactcaaataactggagatgcttatgtttgtgctgcaccaggtgtgatttattttcaagaatcatgttttctttacacctgttcagtttaactgactagcctgttattcagttgatatcttcaagcttcttgtaccggagcagtggagagagat

SEQ ID NO: 1902 - DNA, 200 bp, Lolium multiflorum
atctctctccactgctccggtacaagaagcttgaagatatcaactgaataacaggctagtcagttaaactgaacaggtgtaaagaaaacatgattcttgaaaataaatcacacctggtgcagcacaaacataagcatctccagttatttgagtcccatcactcaatgcaaagtgcttcacggtcccgtcagggttcagtt

SEQ ID NO: 1903 - DNA, 200 bp, Lolium multiflorum
ttgtaccggagcagtggagagagatctcttatttcaagaggctggataagttggtgggagttcctgtcatcaatgttcatatatggtgagttgattgaaactattggttctaagtcaagacaacttcgtgtttttcggttcgacttatatggtcctgcctcatgtgttatttcaggtttgacagaaaactgaaaaacaca

SEQ ID NO: 1904 - DNA, 200 bp, Lolium multiflorum
tgtgtttttcagttttctgtcaaacctgaaataacacatgaggcaggaccatataagtcgaaccgaaaaacacgaagttgtcttgacttagaaccaatagtttcaatcaactcaccatatatgaacattgatgacaggaactcccaccaacttatccagcctcttgaaataagagatctctctccactgctccggtacaa

SEQ ID NO: 1905 - DNA, 200 bp, Lolium multiflorum
gtttgacagaaaactgaaaaacacatacgaccaccttcttttcagcaggtattcctttcttcatactcatcttcctgttggcacctagtgcattttgttgtcttgtattcaaattgagcgtcttcaatcctacccctacatgctttgaatgtgtttttgtttgataccaagtaccagatgtcccttatgttgatcttgtt

SEQ ID NO: 1906 - DNA, 200 bp, Lolium multiflorum
aacaagatcaacataagggacatctggtacttggtatcaaacaaaaacacattcaaagcatgtaggggtaggattgaagacgctcaatttgaatacaagacaacaaaatgcactaggtgccaacaggaagatgagtatgaagaaaggaatacctgctgaaaagaaggtggtcgtatgtgtttttcagttttctgtcaaac

SEQ ID NO: 1907 - DNA, 200 bp, Lolium multiflorum
agatgtcccttatgttgatcttgttcacttctgtttcaggagtccacttttaagcgtctatgcagacatgtcagtagcttgcaaggtactaactcaaggagttattaatattgcatagatactaatatgaggcatgtgatcctgcattcttcttggaatccaccatattaagtattgattgcgggttaaccggaattgta

SEQ ID NO: 1908 - DNA, 200 bp, Lolium multiflorum
tacaattccggttaacccgcaatcaatacttaatatggtggattccaagaagaatgcaggatcacatgcctcatattagtatctatgcaatattaataactccttgagttagtaccttgcaagctactgacatgtctgcatagacgcttaaaagtggactcctgaaacagaagtgaacaagatcaacataagggacatct

SEQ ID NO: 1909 - DNA, 200 bp, Lolium multiflorum
tgattgcgggttaaccggaattgtactttgaggactattgaccaaaggcccaaaatgcttttgctaagaaggaatcattattgaacttaaaattatagatacctttggcattgcaaattgtagttataaattactgaagtatagcatttttgtcattgctaacatgtccgttggctgttgatttcgtgaatcattttagt

SEQ ID NO: 1910 - DNA, 200 bp, Lolium multiflorum
actaaaatgattcacgaaatcaacagccaacggacatgttagcaatgacaaaaatgctatacttcagtaatttataactacaatttgcaatgccaaaggtatctataattttaagttcaataatgattccttcttagcaaaagcattttgggcctttggtcaatagtcctcaaagtacaattccggttaacccgcaatca

SEQ ID NO: 1911 - DNA, 200 bp, Lolium multiflorum
tgttgatttcgtgaatcattttagttagaataactgaataaccgtgctagcttaactgaaagaacgaaggacatggatgcatactcgtaattttattttttccttgttctttaactctatgcaggagtactatgatccagaccgttcaatgctggagttggtctttgctccagcagaggaatggattggacgtagcgacg

SEQ ID NO: 1912 - DNA, 200 bp, Lolium multiflorum
cgtcgctacgtccaatccattcctctgctggagcaaagaccaactccagcattgaacggtctggatcatagtactcctgcatagagttaaagaacaaggaaaaaataaaattacgagtatgcatccatgtccttcgttctttcagttaagctagcacggttattcagttattctaactaaaatgattcacgaaatcaaca

SEQ ID NO: 1913 - DNA, 200 bp, Lolium multiflorum
gaggaatggattggacgtagcgacgctgaaatcatcgaagcaaccatgcaagagctagccaagttatttcctgatgaaattgctgctgatcagagtaaagcaaaaattcgtaaataccatgttgtcaagacgccgaggtgaggacattttgctaacacccatcctgttgattaatcaaaaggacacctgatgtggtcttg

SEQ ID NO: 1914 - DNA, 200 bp, Lolium multiflorum
caagaccacatcaggtgtccttttgattaatcaacaggatgggtgttagcaaaatgtcctcacctcggcgtcttgacaacatggtatttacgaatttttgctttactctgatcagcagcaatttcatcaggaaataacttggctagctcttgcatggttgcttcgatgatttcagcgtcgctacgtccaatccattcctc

SEQ ID NO: 1915 - DNA, 200 bp, Lolium multiflorum
ttcgcgccgctccttccggaaccaaacggtcggaataaaaacatgggtgcgcgcgaccgaataccacctgatccagcaaactgcaggcaaaagatgcactgttccattcaccagcggagctttccggaactcatctctccagctagatcaaagcaaactgatctccggaagatcttcatcctcgcatgcgagaaacccga

SEQ ID NO: 1916 - DNA, 200 bp, Lolium multiflorum
tcgggtttctcgcatgcgaggatgaagatcttccggagatcagtttgctttgatctagctggagagatgagttccggaaagctccgctggtgaatggaacagtgcatcttttgcctgcagtttgctggatcaggtggtattcggtcgcgcgcacccatgtttttattccgaccgtttggttccggaaggagcggcgcgaa

SEQ ID NO: 1917 - DNA, 200 bp, Lolium multiflorum
tcatcctcgcatgcgagaaacccgaggaccgccaccaaaaacaaagaaagatcagcagcccccacgccgccaatccctcttgccggatcaccaaagaagaggacagcgacgcagatcatgcgtacggccgccaaaccgttaccgggggcggaggccgccaccgctccaccgaatcctccatggctaccgacggagagcct

SEQ ID NO: 1918 - DNA, 200 bp, Lolium multiflorum
aggctctccgtcggtagccatggaggattcggtggagcggtggcggcctccgcccccggtaacggtttggcggccgtacgcatgatctgcgtcgctgtcctcttctttggtgatccggcaagagggattggcggcgtgggggctgctgatctttctttgtttttggtggcggtcctcgggtttctcgcatgcgaggatga

SEQ ID NO: 1919 - DNA, 200 bp, Lolium multiflorum
ctccatggctaccgacggagagcctcaggccccagccaagtagccgtgccgcccggcttcctccactggcgctacatcacctcccatggaacgccgccgcggaaaccctcttctccccctcgtcgattcgacgaaaggggtgccgccaccaccgctagagccaggccgggaccggggccgaggcacgggggccggggccg

SEQ ID NO: 1920 - DNA, 200 bp, Lolium multiflorum
cggccccggcccccgtgcctcggccccggtcccggcctggctctagcggtggtggcggcacccctttcgtcgaatcgacgagggggagaagagggtttccgcggcggcgttccatgggaggtgatgtagcgccagtggaggaagccgggcggcacggctacttggctggggcctgaggctctccgtcggtagccatggag

SEQ ID NO: 1921 - DNA, 200 bp, Lolium multiflorum
ggccgaggcacgggggccggggccgaggccagcgccggggtcggggccgcggccggaagcggcagcggctgagggcgacgggcggcgggtggatgtaggccgcggggggaggaggagcctccgccgccgcccgggaggggggcgggagaggggggcggcgggttagggttaggtgagtagccccagatgagtcaaacttc

SEQ ID NO: 1922 - DNA, 200 bp, Lolium multiflorum
gaagtttgactcatctggggctactcacctaaccctaacccgccgcccccctctcccgcccccctcccgggcggcggcggaggctcctcctccccccgcggcctacatccacccgccgcccgtcgccctcagccgctgccgcttccggccgcggccccgaccccggcgctggcctcggccccggcccccgtgcctcggcc

SEQ ID NO: 1923 - DNA, 200 bp, Lolium multiflorum
agtagccccagatgagtcaaacttctattgttgtgttggtgcgttatggtatggcattattgtggtctaatcacctctctgcttgcaggattctaaattgttgtcccgtaggagccaggaaagcctgaagacaaaatccgaagttcccgtcgcttcctaggtgtatttaattagcacacaaatcattcttagcacattct

SEQ ID NO: 1924 - DNA, 200 bp, Lolium multiflorum
agaatgtgctaagaatgatttgtgtgctaattaaatacacctaggaagcgacgggaacttcggattttgtcttcaggctttcctggctcctacgggacaacaatttagaatcctgcaagcagagaggtgattagaccacaataatgccataccataacgcaccaacacaacaatagaagtttgactcatctggggctact

SEQ ID NO: 1925 - DNA, 200 bp, Lolium multiflorum
acacaaatcattcttagcacattctgtggtattttcacactgttgtagagttgaacaggtgattgagctgatatccatattgtgaaaaaggaaatctgtaaaacgagaagctgcataaaagcagctctgatccatatagcaattcttacgttagacctttccggaaggcaaaagtgataaaaaaaggatcttagatatta

SEQ ID NO: 1926 - DNA, 200 bp, Lolium multiflorum
taatatctaagatcctttttttatcacttttgccttccggaaaggtctaacgtaagaattgctatatggatcagagctgcttttatgcagcttctcgttttacagatttcctttttcacaatatggatatcagctcaatcacctgttcaactctacaacagtgtgaaaataccacagaatgtgctaagaatgatttgtgt

SEQ ID NO: 1927 - DNA, 200 bp, Lolium multiflorum
gataaaaaaaggatcttagatattatcttcgtttgcaacaattggaactggatcattaaccgcttacttttctggaattgtataacattaaaacctaaggttcgtgtcagcaaaaggggatgaaatcatggataatatcctagcatctaaatcttgtaagcaaatgggatttatgatatttggcagttgcaacaccaagc

SEQ ID NO: 1928 - DNA, 200 bp, Lolium multiflorum
gcttggtgttgcaactgccaaatatcataaatcccatttgcttacaagatttagatgctaggatattatccatgatttcatccccttttgctgacacgaaccttaggttttaatgttatacaattccagaaaagtaagcggttaatgatccagttccaattgttgcaaacgaagataatatctaagatcctttttttatc

SEQ ID NO: 1929 - DNA, 200 bp, Lolium multiflorum
agtacctctccgagctccacatattagccttgggtgtttctgcctcctttggtcgatccttctctgtgtctgatgatcaccggggagatgagcgaaacgtctgtggatggaccgcttaaggcacagccaccggccatccgcattcctcaggtaacaacaactcctcttgcaggcacgtggtccttgtttattttcatttt

SEQ ID NO: 1930 - DNA, 200 bp, Lolium multiflorum
aaaatgaaaataaacaaggaccacgtgcctgcaagaggagttgttgttacctgaggaatgcggatggccggtggctgtgccttaagcggtccatccacagacgtttcgctcatctccccggtgatcatcagacacagagaaggatcgaccaaaggaggcagaaacacccaaggctaatatgtggagctcggagaggtact

SEQ ID NO: 1931 - DNA, 200 bp, Lolium multiflorum
cgtggtccttgtttattttcatttttgttcttgctgctcattactttcatgctttgcttcctaatgatatgcttgctccatttactaacagttacacattcggcagattcatggtcaatctcttgttgcggacataaaactccttttattttttccaagtccgaaattatttgcatacatagatgttgctatcatattct

SEQ ID NO: 1932 - DNA, 200 bp, Lolium multiflorum
agaatatgatagcaacatctatgtatgcaaataatttcggacttggaaaaaataaaaggagttttatgtccgcaacaagagattgaccatgaatctgccgaatgtgtaactgttagtaaatggagcaagcatatcattaggaagcaaagcatgaaagtaatgagcagcaagaacaaaaatgaaaataaacaaggaccacg

SEQ ID NO: 1933 - DNA, 200 bp, Lolium multiflorum
tacatagatgttgctatcatattcttgttcccttgaggccttgacgacataataaaccgattactatcttgttctttggcagggcacgttaacccttttcttttcaagtccaaaacaaataaatcttgttcgtaacagaaaaaacaaaggagcacccaagtgtgctgtttctctgaaatatataccctcatgccattgct

SEQ ID NO: 1934 - DNA, 200 bp, Lolium multiflorum
agcaatggcatgagggtatatatttcagagaaacagcacacttgggtgctcctttgttttttctgttacgaacaagatttatttgttttggacttgaaaagaaaagggttaacgtgccctgccaaagaacaagatagtaatcggtttattatgtcgtcaaggcctcaagggaacaagaatatgatagcaacatctatgta

SEQ ID NO: 1935 - DNA, 189 bp, Lolium multiflorum; identical to SEQ ID NO: 78

SEQ ID NO: 1936 - DNA, 189 bp, Lolium multiflorum
tcttttgatattaatatattccctttatctaaaaaaagaagtttgactcatctatgtgcaaccagaaccgtggagagcatttacctggactatggactgggcacagagcttcccggataaaactgcaccctccatggaagccaaatatttctgcttcgtgtaatcaccagccagatagaacccttcgat

SEQ ID NO: 1937 - DNA, 200 bp, Lolium multiflorum
attacagatacctttggcattgcaaattgtagttatcaattactgaagtatagcatttttgtcattgctaacatgtcagtcggctgttgatttcgtgaatcattttagtttgaataactgaataaccgtgctagcttaactgagagaacgaaggacatggatgcatactcgtaattttgattttcccttgttctttaact

SEQ ID NO: 1938 - DNA, 200 bp, Lolium multiflorum
agttaaagaacaagggaaaatcaaaattacgagtatgcatccatgtccttcgttctctcagttaagctagcacggttattcagttattcaaactaaaatgattcacgaaatcaacagccgactgacatgttagcaatgacaaaaatgctatacttcagtaattgataactacaatttgcaatgccaaaggtatctgtaat

SEQ ID NO: 1939 - DNA, 200 bp, Lolium multiflorum
tttgattttcccttgttctttaactctatgcaggagtattatgatccagaccgttcaatgctggagttggtgtttgctccagcagaggaatggattggacgtagcgacgctgaaatcatcgaagcaaccatgcaagagctagccaagttatttcctgatgaaattgctgctgatcagagtaaagcaaaaattcgtaaata

SEQ ID NO: 1940 - DNA, 200 bp, Lolium multiflorum
tatttacgaatttttgctttactctgatcagcagcaatttcatcaggaaataacttggctagctcttgcatggttgcttcgatgatttcagcgtcgctacgtccaatccattcctctgctggagcaaacaccaactccagcattgaacggtctggatcataatactcctgcatagagttaaagaacaagggaaaatcaaa

SEQ ID NO: 1941 - DNA, 200 bp, Lolium multiflorum
agagtaaagcaaaaattcgtaaataccatgttgtgaagacgccgaggtgaggacattttgccaacacccatcctgttgattaatcaaaaggacacctgatgtggtcttgttctcttacactgtttatatttttctggctcgctgttacagatctgtttacaagaccatcccagattgtgagccttgccgacctctgcaac

SEQ ID NO: 1942 - DNA, 200 bp, Lolium multiflorum
gttgcagaggtcggcaaggctcacaatctgggatggtcttgtaaacagatctgtaacagcgagccagaaaaatataaacagtgtaagagaacaagaccacatcaggtgtccttttgattaatcaacaggatgggtgttggcaaaatgtcctcacctcggcgtcttcacaacatggtatttacgaatttttgctttactct

SEQ ID NO: 1943 - DNA, 200 bp, Lolium multiflorum
tgtgagccttgccgacctctgcaacgatcaccgatcgaagggttctatctggctggtgattacacgaagcagaaatatttggcttccatggagggtgcagttttatccgggaagctctgtgcccagtccatagttcaggtaaatgctttccacggttctggttgcacatagatgagtcaaacttctattgttgtgttggt

SEQ ID NO: 1944 - DNA, 200 bp, Lolium multiflorum
accaacacaacaatagaagtttgactcatctatgtgcaaccagaaccgtggaaagcatttacctgaactatggactgggcacagagcttcccggataaaactgcaccctccatggaagccaaatatttctgcttcgtgtaatcaccagccagatagaacccttcgatcggtgatcgttgcagaggtcggcaaggctcaca

SEQ ID NO: 1945 - DNA, 200 bp, Lolium multiflorum
gtcaaacttctattgttgtgttggtgcgttatgatatggcattattgtggtctaatcacctctctacttgcaggattctaaattgttgtcccgtaggagccaggaaagcctgaagacaaaatccgaagttcccgtcgcttcctaggtgtatttagttagcacacaattcattcttagcacattctgtggtattttcacac

SEQ ID NO: 1946 - DNA, 200 bp, Lolium multiflorum
gtgtgaaaataccacagaatgtgctaagaatgaattgtgtgctaactaaatacacctaggaagcgacgggaacttcggattttgtcttcaggctttcctggctcctacgggacaacaatttagaatcctgcaagtagagaggtgattagaccacaataatgccatatcataacgcaccaacacaacaatagaagtttgac

SEQ ID NO: 1947 - DNA, 200 bp, Lolium multiflorum
caaaagttcagaacaaaaaaatagagagaaacaccaaagttgtttctctgaaaccgtcatgccattctttaaaaggaagaagaggtattttcaaaacatcgtgcttcactgcttctgctgattatgtgcatatacaaagttataagttcattggaaacgatactagttagcctttagacatgcatttggatccctgcttt

SEQ ID NO: 1948 - DNA, 200 bp, Lolium multiflorum
aaagcagggatccaaatgcatgtctaaaggctaactagtatcgtttccaatgaacttataactttgtatatgcacataatcagcagaagcagtgaagcacgatgttttgaaaatacctcttcttccttttaaagaatggcatgacggtttcagagaaacaactttggtgtttctctctatttttttgttctgaacttttg

SEQ ID NO: 1949 - DNA, 200 bp, Lolium multiflorum
agacatgcatttggatccctgctttgtttcatgttgttagcaaattcctacacccttgaaataaaaagattattatcttgctgttcttttaaagggtaacttgattgtgaacgtgatgccggcgggctggacagatgggaggcacagactttatataagctccatggaagcctctttcatcgatcaactctacggctaca

SEQ ID NO: 1950 - DNA, 200 bp, Lolium multiflorum
tgtagccgtagagttgatcgatgaaagaggcttccatggagcttatataaagtctgtgcctcccatctgtccagcccgccggcatcacgttcacaatcaagttaccctttaaaagaacagcaagataataatctttttatttcaagggtgtaggaatttgctaacaacatgaaacaaagcagggatccaaatgcatgtct

SEQ ID NO: 1951 - DNA, 200 bp, Lolium multiflorum
ttcatcgatcaactctacggctacaaagtaaatcagaaagcccatgacttgaaaatcatccgcggtggagtgttggggaaactcaaatcgcagaggaccaatgttcgtgctccagtaacgggtgaatgcctcctgcctgcaaacccgtggatgcgtgactgcagcagcagcagcagcaatgcaagaagtgatgtagcaaa

SEQ ID NO: 1952 - DNA, 200 bp, Lolium multiflorum
tttgctacatcacttcttgcattgctgctgctgctgctgcagtcacgcatccacgggtttgcaggcaggaggcattcacccgttactggagcacgaacattggtcctctgcgatttgagtttccccaacactccaccgcggatgattttcaagtcatgggctttctgatttactttgtagccgtagagttgatcgatgaa

SEQ ID NO: 1953 - DNA, 200 bp, Lolium multiflorum
gcaatgcaagaagtgatgtagcaaaaaccgcagtgggtgatcacgagtctggtatatggactatccatgggaggagtccgctgtcgcatgaaagggaattgggagcttgcaatggagaaaaacttctccatgataatacaggtagctatctcagttacctcattcaacttccggtgtatcatatgttttcaacactagct

SEQ ID NO: 1954 - DNA, 200 bp, Lolium multiflorum
agctagtgttgaaaacatatgatacaccggaagttgaatgaggtaactgagatagctacctgtattatcatggagaagtttttctccattgcaagctcccaattccctttcatgcgacagcggactcctcccatggatagtccatataccagactcgtgatcacccactgcggtttttgctacatcacttcttgcattgc

SEQ ID NO: 1955 - DNA, 200 bp, Lolium multiflorum
gtatcatatgttttcaacactagctgattttatggaagatgcatgaacaattcaaaaatcaattgtgtgtaagctccaagatgctgtctgtctgaacgtacctatgttagcaataagctcgtaaaagttagactgctaaccatgctctgaagcagtctgctacgaagaactaaatatctgatgccattttttttctctcc

SEQ ID NO: 1956 - DNA, 200 bp, Lolium multiflorum
ggagagaaaaaaaatggcatcagatatttagttcttcgtagcagactgcttcagagcatggttagcagtctaacttttacgagcttattgctaacataggtacgttcagacagacagcatcttggagcttacacacaattgatttttgaattgttcatgcatcttccataaaatcagctagtgttgaaaacatatgatac

SEQ ID NO: 1957 - DNA, 200 bp, Lolium multiflorum
atctgatgccattttttttctctccctgcagaggtctctgatgagaacttttctgactacgagacgaaactcgatgcggaatcaagtaaattgtgcaagaaaaggaggttaagcagtacttccacttactgaatgatcaaatgagctcgcatgattaattagcatatagtgtgttgcaagcattgagatgaaaagcaaca

SEQ ID NO: 1958 - DNA, 200 bp, Lolium multiflorum
tgttgcttttcatctcaatgcttgcaacacactatatgctaattaatcatgcgagctcatttgatcattcagtaagtggaagtactgcttaacctccttttcttgcacaatttacttgattccgcatcgagtttcgtctcgtagtcagaaaagttctcatcagagacctctgcagggagagaaaaaaaatggcatcagat

SEQ ID NO: 1959 - DNA, 200 bp, Lolium multiflorum
gcaagcattgagatgaaaagcaacacaccgaattactcaaagaacctgtttgctgcctcaaaatctgttcggagcctgtttgtatcctgtcagacgccctcactcactacttggagtagtagataatattgtttcgtttattggatgcaaatgcaatgcattctataaagtttgactaattatatggaaaaaaattaaca

SEQ ID NO: 1960 - DNA, 200 bp, Lolium multiflorum
tgttaatttttttccatataattagtcaaactttatagaatgcattgcatttgcatccaataaacgaaacaatattatctactactccaagtagtgagtgagggcgtctgacaggatacaaacaggctccgaacagattttgaggcagcaaacaggttctttgagtaattcggtgtgttgcttttcatctcaatgcttgc

SEQ ID NO: 1961 - DNA, 200 bp, Lolium multiflorum
ctaattatatggaaaaaaattaacaactaaaatatcatatcactgttattagaaccaccatggaatatattttcatagtatatgcatttggtattgcgatgtatgctgaaatagagtgggtattatctctaggaggcttcttcctttcaagtcaagttttgtatcccgatatatactcacccgagaccgagagacaccga

SEQ ID NO: 1962 - DNA, 200 bp, Lolium multiflorum
tcggtgtctctcggtctcgggtgagtatatatcgggatacaaaacttgacttgaaaggaagaagcctcctagagataatacccactctatttcagcatacatcgcaataccaaatgcatatactatgaaaatatattccatggtggttctaataacagtgatatgatattttagttgttaatttttttccatataattag

SEQ ID NO: 1963 - DNA, 200 bp, Lolium multiflorum
ctcacccgagaccgagagacaccgatacaacaatgtccaaagagtaacgtcaatttcatactctttcaggaaccatgcatctaaggcaaacgttgtaattaatcaataaggtacaatatgagaccagagtgtggtgcttggccggggccaaatattttagtaatgtaatcccaagagagtagtatgtcgtgtaatgccta

SEQ ID NO: 1964 - DNA, 200 bp, Lolium multiflorum
taggcattacacgacatactactctcttgggattacattactaaaatatttggccccggccaagcaccacactctggtctcatattgtaccttattgattaattacaacgtttgccttagatgcatggttcctgaaagagtatgaaattgacgttactctttggacattgttgtatcggtgtctctcggtctcgggtgag

SEQ ID NO: 1965 - DNA, 200 bp, Lolium multiflorum
cctttgtactctgtgtataggttatatccattggcagtgtacagatagtatttgatgcctcagacaaatatgtacacaataataagatagaacaccttgagtgaagtacaaagtgatttttgagtagtcacattgaggttctgaaattgcaaataagagaagagtttcatactgtcaaatttttagcttgtttgcatttt

SEQ ID NO: 1966 - DNA, 200 bp, Lolium multiflorum
aaaatgcaaacaagctaaaaatttgacagtatgaaactcttctcttatttgcaatttcagaacctcaatgtgactactcaaaaatcactttgtacttcactcaaggtgttctatcttattattgtgtacatatttgtctgaggcatcaaatactatctgtacactgccaatggatataacctatacacagagtacaaagg

SEQ ID NO: 1967 - DNA, 200 bp, Lolium multiflorum
caaatttttagcttgtttgcattttattaatgggccttattctcttaataatatttttaccgggttttttgcgtgactgtatgaaaatatataagggattcacgcatacagtagcttagattttaatgttccatacatcattgttggcctggttgaatttttttttgtctataaattctcttctaccagccttttctccc

SEQ ID NO: 1968 - DNA, 200 bp, Lolium multiflorum
gggagaaaaggctggtagaagagaatttatagacaaaaaaaaattcaaccaggccaacaatgatgtatggaacattaaaatctaagctactgtatgcgtgaatcccttatatattttcatacagtcacgcaaaaaacccggtaaaaatattattaagagaataaggcccattaataaaatgcaaacaagctaaaaatttg

SEQ ID NO: 1969 - DNA, 200 bp, Lolium multiflorum
ttctcttctaccagccttttctccctgccggtagcttgtgtacggtacttctcattctgtgcatgtatgtaaccatatgttttttttttgggttttaagttggagcttatcccaacgtacagaatttgtttggtgagcttggtattaatgatcgcttgcaatggaaggaacactctatgatatttgccatgccaaacaag

SEQ ID NO: 1970 - DNA, 200 bp, Lolium multiflorum
cttgtttggcatggcaaatatcatagagtgttccttccattgcaagcgatcattaataccaagctcaccaaacaaattctgtacgttgggataagctccaacttaaaacccaaaaaaaaaacatatggttacatacatgcacagaatgagaagtaccgtacacaagctaccggcagggagaaaaggctggtagaagagaa

SEQ ID NO: 1971 - DNA, 200 bp, Lolium multiflorum
tatgatatttgccatgccaaacaagccaggagaatacagccgttttgatttcccagaggttttgccagcgcctttaaacggtaagatcatacatagccctggtgttgcttaatagatgaaagaatggcaagaaaacttaggaatgcatcctagtgttagttctttcattttgctaatatttgaatgcaactagtggggta

SEQ ID NO: 1972 - DNA, 200 bp, Lolium multiflorum
taccccactagttgcattcaaatattagcaaaatgaaagaactaacactaggatgcattcctaagttttcttgccattctttcatctattaagcaacaccagggctatgtatgatcttaccgtttaaaggcgctggcaaaacctctgggaaatcaaaacggctgtattctcctggcttgtttggcatggcaaatatcata

SEQ ID NO: 1973 - DNA, 200 bp, Lolium multiflorum
atatttgaatgcaactagtggggtatgttagtgcaaacaacattgtcatggccatccagctgttctcttcccatcaatgtcagtttatcattgattatgcatgtatttaacaggaatatgggccatactgaagaacaatgaaatgcttacttggccggagaaggtgaagtttgctattggacttcttccagcaatgcttg

SEQ ID NO: 1974 - DNA, 200 bp, Lolium multiflorum
caagcattgctggaagaagtccaatagcaaacttcaccttctccggccaagtaagcatttcattgttcttcagtatggcccatattcctgttaaatacatgcataatcaatgataaactgacattgatgggaagagaacagctggatggccatgacaatgttgtttgcactaacataccccactagttgcattcaaatat

SEQ ID NO: 1975 - DNA, 200 bp, Lolium multiflorum
attggacttcttccagcaatgcttggtggccaagcttatgttgaagctcaagatggcttaactgtttcagagtggatggaaaagcaggtatgagcccaccaagtcagttagactcatctctttgtactgaacacatagccgtctcaattcacacttgatatatgaggatatgttgtaacgcgataaattgctgccttcct

SEQ ID NO: 1976 - DNA, 200 bp, Lolium multiflorum
aggaaggcagcaatttatcgcgttacaacatatcctcatatatcaagtgtgaattgagacggctatgtgttcagtacaaagagatgagtctaactgacttggtgggctcatacctgcttttccatccactctgaaacagttaagccatcttgagcttcaacataagcttggccaccaagcattgctggaagaagtccaat

SEQ ID NO: 1977 - DNA, 200 bp, Lolium multiflorum
gcgcttatcgttgattaaaccagggctgacaagaatctaccagcagctgcttcattatggatacaggctgcttatcatctatgaacataactggagctgcgcaagtgcggtcctttgtgggacaacttcatacacagaggtgcttcacaagcagcagtgtccagccgctgaaaagtagttctccaacgagcgctggtttg

SEQ ID NO: 1978 - DNA, 200 bp, Lolium multiflorum
caaaccagcgctcgttggagaactacttttcagcggctggacactgctgcttgtgaagcacctctgtgtatgaagttgtcccacaaaggaccgcacttgcgcagctccagttatgttcatagatgataagcagcctgtatccataatgaagcagctgctggtagattcttgtcagccctggtttaatcaacgataagcgc

SEQ ID NO: 1979 - DNA, 200 bp, Lolium multiflorum
tagttctccaacgagcgctggtttggcgtctcttggctcaaggaatagagggaaaaaatcacgccgtgggcttgctgctctgcaggttgtttcccaggatttaccaagacctccactggaaaacacaattaactatctggaagctgggcagctttcttcatcttttagaagcagtgaacgacccagtaaaccattacagg

SEQ ID NO: 1980 - DNA, 200 bp, Lolium multiflorum
cctgtaatggtttactgggtcgttcactgcttctaaaagatgaagaaagctgcccagcttccagatagttaattgtgttttccagtggaggtcttggtaaatcctgggaaacaacctgcagagcagcaagcccacggcgtgattttttccctctattccttgagccaagagacgccaaaccagcgctcgttggagaacta

SEQ ID NO: 1981 - DNA, 200 bp, Lolium multiflorum
gaacgacccagtaaaccattacaggtcgtgattgctggtgcaggattggctggactatcaactgcaaaatatctagcagatgctggccataaacccatattgctagaggcaagagatgttttgggtggaaagttagctgcttggaaggatgaagatggtgattggtatgagactggtcttcatattttctttggagctta

SEQ ID NO: 1982 - DNA, 200 bp, Lolium multiflorum
taagctccaaagaaaatatgaagaccagtctcataccaatcaccatcttcatccttccaagcagctaactttccacccaaaacatctcttgcctctagcaatatgggtttatggccagcatctgctagatattttgcagttgatagtccagccaatcctgcaccagcaatcacgacctgtaatggtttactgggtcgttc

SEQ ID NO: 1983 - DNA, 200 bp, Lolium multiflorum
gtcttcatattttctttggagcttatcccaacgtacagaatttgtttggtgagcttggtattaatgatcgcttgcaatggaaggaacactctatgatatttgccatgccaaacaagccaggagaatacagccgttttgatttcccagaggttttgccagcgcctttaaacggaatatgggccatactgaagaacaatgaa

SEQ ID NO: 1984 - DNA, 200 bp, Lolium multiflorum
ttcattgttcttcagtatggcccatattccgtttaaaggcgctggcaaaacctctgggaaatcaaaacggctgtattctcctggcttgtttggcatggcaaatatcatagagtgttccttccattgcaagcgatcattaataccaagctcaccaaacaaattctgtacgttgggataagctccaaagaaaatatgaagac

SEQ ID NO: 1985 - DNA, 200 bp, Lolium multiflorum
atgggccatactgaagaacaatgaaatgcttacttggccggagaaggtgaagtttgctattggacttcttccagcaatgcttggtggccaagcttatgttgaagctcaagatggcttaactgtttcagagtggatggaaaagcagggtgttcctgatcgagtcaacgatgaggtttttattgcaatgtccaaggcactca

SEQ ID NO: 1986 - DNA, 200 bp, Lolium multiflorum
tgagtgccttggacattgcaataaaaacctcatcgttgactcgatcaggaacaccctgcttttccatccactctgaaacagttaagccatcttgagcttcaacataagcttggccaccaagcattgctggaagaagtccaatagcaaacttcaccttctccggccaagtaagcatttcattgttcttcagtatggcccat

SEQ ID NO: 1987 - DNA, 200 bp, Lolium multiflorum
tttattgcaatgtccaaggcactcaatttcataaaccctgatgagttatccatgcagtgcattcttattgctctaaaccgatttctccaggagaagcatggctcaaaaatggcattcttggatggtaatccacctgaaaggctatgtatgcctattgtcaaccacattcagtctttgggtggtgaggtccgcctgaactc

SEQ ID NO: 1988 - DNA, 200 bp, Lolium multiflorum
gagttcaggcggacctcaccacccaaagactgaatgtggttgacaataggcatacatagcctttcaggtggattaccatccaagaatgccatttttgagccatgcttctcctggagaaatcggtttagagcaataagaatgcactgcatggataactcatcagggtttatgaaattgagtgccttggacattgcaataaa

SEQ ID NO: 1989 - DNA, 200 bp, Lolium multiflorum
tgggtggtgaggtccgcctgaactctcgtattaagaaaattgaactgaaccctgacgggactgtgaagcactttgcattgagtgatgggactcaaataactggagatgcttatgtttgtgctgcaccagttgatatcttcaagcttcttgtaccggaacagtggagagagatctcttatttcaagaggctggataagttg

SEQ ID NO: 1990 - DNA, 200 bp, Lolium multiflorum
caacttatccagcctcttgaaataagagatctctctccactgttccggtacaagaagcttgaagatatcaactggtgcagcacaaacataagcatctccagttatttgagtcccatcactcaatgcaaagtgcttcacagtcccgtcagggttcagttcaattttcttaatacgagagttcaggcggacctcaccaccca

SEQ ID NO: 1991 - DNA, 200 bp, Lolium multiflorum
ttatttcaagaggctggataagttggtgggagttcctgtcatcaatgttcatatatggtttgacagaaaactgaaaaacacatacgaccaccttcttttcagcaggagtccacttttaagcgtctatgcagacatgtcagtagcgtgcaaggagtattatgatccagaccgttcaatgctggagttggtgtttgctccag

SEQ ID NO: 1992 - DNA, 200 bp, Lolium multiflorum
ctggagcaaacaccaactccagcattgaacggtctggatcataatactccttgcacgctactgacatgtctgcatagacgcttaaaagtggactcctgctgaaaagaaggtggtcgtatgtgtttttcagttttctgtcaaaccatatatgaacattgatgacaggaactcccaccaacttatccagcctcttgaaataa

SEQ ID NO: 1993 - DNA, 200 bp, Lolium multiflorum
atgctggagttggtgtttgctccagcagaggaatggattggacgtagcgacgctgaaatcatcgaagcaaccatgcaagagctagccaagttatttcctgatgaaattgctgctgatcagagtaaagcaaaaattcgtaaataccatgttgtgaagacaccgagatctgtttacaagaccatcccagattgtgaaccttg

SEQ ID NO: 1994 - DNA, 200 bp, Lolium multiflorum
caaggttcacaatctgggatggtcttgtaaacagatctcggtgtcttcacaacatggtatttacgaatttttgctttactctgatcagcagcaatttcatcaggaaataacttggctagctcttgcatggttgcttcgatgatttcagcgtcgctacgtccaatccattcctctgctggagcaaacaccaactccagcat

SEQ ID NO: 1995 - DNA, 200 bp, Lolium multiflorum
tcttggctcaaggaatagagggaaaaaatcacgccgtgggcttgctgctctgcaggttaagatttcgtccctgttcggaaaataaagtggtttctctattttatctcaccacagccgtttcttgtgaagtaattgtttgcattttctgcaggttgtttcccaggatttaccaagacctccactggaaaacacaattaact

SEQ ID NO: 1996 - DNA, 200 bp, Lolium multiflorum
agttaattgtgttttccagtggaggtcttggtaaatcctgggaaacaacctgcagaaaatgcaaacaattacttcacaagaaacggctgtggtgagataaaatagagaaaccactttattttccgaacagggacgaaatcttaacctgcagagcagcaagcccacggcgtgattttttccctctattccttgagccaaga

SEQ ID NO: 1997 - DNA, 200 bp, Lolium multiflorum
cctccactggaaaacacaattaactatctggaagctgggcagctttcttcatcttttagaagcagtgaacgacccagtaaaccattacaggtcgtgattgctggtgcaggtctgatgtaactcctggattagaacatatatgaatttcacaaattagataccccccctgagtgaagcacaactgcctcttagcgttactc

SEQ ID NO: 1998 - DNA, 200 bp, Lolium multiflorum
gagtaacgctaagaggcagttgtgcttcactcagggggggtatctaatttgtgaaattcatatatgttctaatccaggagttacatcagacctgcaccagcaatcacgacctgtaatggtttactgggtcgttcactgcttctaaaagatgaagaaagctgcccagcttccagatagttaattgtgttttccagtggagg

SEQ ID NO: 1999 - DNA, 200 bp, Lolium multiflorum
gcacaactgcctcttagcgttactcgtctctggtgtgaattgtgcaggattggctggactatcaaccgcaaaatatctagcagatgctggccataaacccatattgctagaagcaagagatgttttgggcggaaaggtctgatagtttcttacatctgttgcttatctcatctctaaaattgtgctggttatttaatctg

SEQ ID NO: 2000 - DNA, 200 bp, Lolium multiflorum
cagattaaataaccagcacaattttagagatgagataagcaacagatgtaagaaactatcagacctttccgcccaaaacatctcttgcttctagcaatatgggtttatggccagcatctgctagatattttgcggttgatagtccagccaatcctgcacaattcacaccagagacgagtaacgctaagaggcagttgtgc

SEQ ID NO: 2001 - DNA, 200 bp, Lolium multiflorum
aaaattgtgctggttatttaatctgacttttcagttgctgtcgtcattctgagtagctcaccttcaccattattgttgcttgattgcttctatccttgtatgccttcaacagttagctgcttggaaggatgaagatggtgattggtatgaaactggtcttcatattttctgtaagttacggtacttccttgttcctttgt

SEQ ID NO: 2002 - DNA, 200 bp, Lolium multiflorum
acaaaggaacaaggaagtaccgtaacttacagaaaatatgaagaccagtttcataccaatcaccatcttcatccttccaagcagctaactgttgaaggcatacaaggatagaagcaatcaagcaacaataatggtgaaggtgagctactcagaatgacgacagcaactgaaaagtcagattaaataaccagcacaatttt

SEQ ID NO: 2003 - DNA, 200 bp, Lolium multiflorum
ttacggtacttccttgttcctttgtgccctgtgtatagcttgtttccactggcagtgtatagatagtatttgatgcgtcagacaaatatctacataataataagatagaataccttgagtaaagtacaaaatgatctttgaggagccacattgaggttctgaaattgcaaataagtgaagagtttcataccgtcaaattt

SEQ ID NO: 2004 - DNA, 200 bp, Lolium multiflorum
aaatttgacggtatgaaactcttcacttatttgcaatttcagaacctcaatgtggctcctcaaagatcattttgtactttactcaaggtattctatcttattattatgtagatatttgtctgacgcatcaaatactatctatacactgccagtggaaacaagctatacacagggcacaaaggaacaaggaagtaccgtaa

SEQ ID NO: 2005 - DNA, 200 bp, Lolium multiflorum
ttcaacagttagctgcttggaaggatgaagatggtgattggtatgaaactggtcttcatattttctgtaagttacggtacttccttgttcctttgtgccctgtgtatagcgtgtttccactggcagtgtatagatagtatttgatgcgtcagacaaatatctacataataataagatagaacaccttgagtaaagtacaa

SEQ ID NO: 2006 - DNA, 200 bp, Lolium multiflorum
ttgtactttactcaaggtgttctatcttattattatgtagatatttgtctgacgcatcaaatactatctatacactgccagtggaaacacgctatacacagggcacaaaggaacaaggaagtaccgtaacttacagaaaatatgaagaccagtttcataccaatcaccatcttcatccttccaagcagctaactgttgaa

SEQ ID NO: 2007 - DNA, 200 bp, Lolium multiflorum
atagaacaccttgagtaaagtacaaaatgatctttgaggagccacatttaggttctgaaattgcaaattagtgaagagtttcataccgtcaattttttaggttgcttgcattttattaatgggccttattctcttaataatatttttagtgggtttttttttgcgtgaccgtatgaaaacatatagcttaaatttcaatg

SEQ ID NO: 2008 - DNA, 200 bp, Lolium multiflorum
cattgaaatttaagctatatgttttcatacggtcacgcaaaaaaaaacccactaaaaatattattaagagaataaggcccattaataaaatgcaagcaacctaaaaaattgacggtatgaaactcttcactaatttgcaatttcagaacctaaatgtggctcctcaaagatcattttgtactttactcaaggtgttctat

SEQ ID NO: 2009 - DNA, 200 bp, Lolium multiflorum
aaaacatatagcttaaatttcaatgttccatacatcgttgttggcatggtggaatatttcttttgtctataaattctcttctaccagcatttcctccctgccagtagcttgtgtacggtattcattctgtgcatgtatgtaaccatatgttttttttttgggggggtttaagttggagcttatcccaacgtacagaattt

SEQ ID NO: 2010 - DNA, 200 bp, Lolium multiflorum
aaattctgtacgttgggataagctccaacttaaacccccccaaaaaaaaaacatatggttacatacatgcacagaatgaataccgtacacaagctactggcagggaggaaatgctggtagaagagaatttatagacaaaagaaatattccaccatgccaacaacgatgtatggaacattgaaatttaagctatatgtttt

SEQ ID NO: 2011 - DNA, 21 bp, Unknown
  Found in multiple species
ttaatgttcacatatggtttg

SEQ ID NO: 2012 - DNA, 21 bp, Unknown
  Found in multiple species
tcaaaccatatgtgaacatta

SEQ ID NO: 2013 - DNA, 21 bp, Unknown
  Found in multiple species
taatgttcacatatggtttga

SEQ ID NO: 2014 - DNA, 21 bp, Unknown
  Found in multiple species
caaaccatatgtgaacattaa

SEQ ID NO: 2015 - DNA, 21 bp, Unknown
  Found in multiple species
attaatgttcacatatggttt

SEQ ID NO: 2016 - DNA, 21 bp, Unknown
  Found in multiple species
aaaccatatgtgaacattaat

SEQ ID NO: 2017 - DNA, 21 bp, Unknown
  Found in multiple species
tttttgaagtatgagatttcc

SEQ ID NO: 2018 - DNA, 21 bp, Unknown
  Found in multiple species
ttttgaagtatgagatttcct

SEQ ID NO: 2019 - DNA, 21 bp, Unknown
  Found in multiple species
ttttctgtcaaaccatatgtg

SEQ ID NO: 2020 - DNA, 21 bp, Unknown
  Found in multiple species
tttgacagaaaattaaagaat

SEQ ID NO: 2021 - DNA, 21 bp, Unknown
  Found in multiple species
tttgaagtatgagatttcctt

SEQ ID NO: 2022 - DNA, 21 bp, Unknown
  Found in multiple species
tttctgtcaaaccatatgtga

SEQ ID NO: 2023 - DNA, 21 bp, Unknown
  Found in multiple species
tttaattttctgtcaaaccat

SEQ ID NO: 2024 - DNA, 21 bp, Unknown
  Found in multiple species
ttggaaggaaatctcatactt

SEQ ID NO: 2025 - DNA, 21 bp, Unknown
  Found in multiple species
ttgacagaaaattaaagaata

SEQ ID NO: 2026 - DNA, 21 bp, Unknown
  Found in multiple species
ttgaagtatgagatttccttc

SEQ ID NO: 2027 - DNA, 21 bp, Unknown
  Found in multiple species
ttctttaattttctgtcaaac

SEQ ID NO: 2028 - DNA, 21 bp, Unknown
  Found in multiple species
ttctgtcaaaccatatgtgaa

SEQ ID NO: 2029 - DNA, 21 bp, Unknown
  Found in multiple species
ttcctgtgattaatgttcaca

SEQ ID NO: 2030 - DNA, 21 bp, Unknown
  Found in multiple species
ttcacatatggtttgacagaa

SEQ ID NO: 2031 - DNA, 21 bp, Unknown
  Found in multiple species
ttagtgggcgttcctgtgatt

SEQ ID NO: 2032 - DNA, 21 bp, Unknown
  Found in multiple species
ttaattttctgtcaaaccata

SEQ ID NO: 2033 - DNA, 21 bp, Unknown
  Found in multiple species
ttaatcacaggaacgcccact

SEQ ID NO: 2034 - DNA, 21 bp, Unknown
  Found in multiple species
tgttcacatatggtttgacag

SEQ ID NO: 2035 - DNA, 21 bp, Unknown
  Found in multiple species
tgtgattaatgttcacatatg

SEQ ID NO: 2036 - DNA, 21 bp, Unknown
  Found in multiple species
tgtgaacattaatcacaggaa

SEQ ID NO: 2037 - DNA, 21 bp, Unknown
  Found in multiple species
tgtcaaaccatatgtgaacat

SEQ ID NO: 2038 - DNA, 21 bp, Unknown
  Found in multiple species
tggtttgacagaaaattaaag

SEQ ID NO: 2039 - DNA, 21 bp, Unknown
  Found in multiple species
tgggcgttcctgtgattaatg

SEQ ID NO: 2040 - DNA, 21 bp, Unknown
  Found in multiple species
tggaaggaaatctcatacttc

SEQ ID NO: 2041 - DNA, 21 bp, Unknown
  Found in multiple species
tgattaatgttcacatatggt

SEQ ID NO: 2042 - DNA, 21 bp, Unknown
  Found in multiple species
tgagatttccttccaagtatc

SEQ ID NO: 2043 - DNA, 21 bp, Unknown
  Found in multiple species
tgacagaaaattaaagaatac

SEQ ID NO: 2044 - DNA, 21 bp, Unknown
  Found in multiple species
tgaagtatgagatttccttcc

SEQ ID NO: 2045 - DNA, 21 bp, Unknown
  Found in multiple species
tgaacattaatcacaggaacg

SEQ ID NO: 2046 - DNA, 21 bp, Unknown
  Found in multiple species
tctttaattttctgtcaaacc

SEQ ID NO: 2047 - DNA, 21 bp, Unknown
  Found in multiple species
tctgtcaaaccatatgtgaac

SEQ ID NO: 2048 - DNA, 21 bp, Unknown
  Found in multiple species
tctcatacttcaaaaagcttg

SEQ ID NO: 2049 - DNA, 21 bp, Unknown
  Found in multiple species
tcctgtgattaatgttcacat

SEQ ID NO: 2050 - DNA, 21 bp, Unknown
  Found in multiple species
tcacatatggtttgacagaaa

SEQ ID NO: 2051 - DNA, 21 bp, Unknown
  Found in multiple species
tcacaggaacgcccactaatt

SEQ ID NO: 2052 - DNA, 21 bp, Unknown
  Found in multiple species
tcaagctttttgaagtatgag

SEQ ID NO: 2053 - DNA, 21 bp, Unknown
  Found in multiple species
tattctttaattttctgtcaa

SEQ ID NO: 2054 - DNA, 21 bp, Unknown
  Found in multiple species
tatgtgaacattaatcacagg

SEQ ID NO: 2055 - DNA, 21 bp, Unknown
  Found in multiple species
tatggtttgacagaaaattaa

SEQ ID NO: 2056 - DNA, 21 bp, Unknown
  Found in multiple species
tatgagatttccttccaagta

SEQ ID NO: 2057 - DNA, 21 bp, Unknown
  Found in multiple species
tagtgggcgttcctgtgatta

SEQ ID NO: 2058 - DNA, 21 bp, Unknown
  Found in multiple species
tacttggaaggaaatctcata

SEQ ID NO: 2059 - DNA, 21 bp, Unknown
  Found in multiple species
taattttctgtcaaaccatat

SEQ ID NO: 2060 - DNA, 21 bp, Unknown
  Found in multiple species
taatcacaggaacgcccacta

SEQ ID NO: 2061 - DNA, 21 bp, Unknown
  Found in multiple species
gtttgacagaaaattaaagaa

SEQ ID NO: 2062 - DNA, 21 bp, Unknown
  Found in multiple species
gttcctgtgattaatgttcac

SEQ ID NO: 2063 - DNA, 21 bp, Unknown
  Found in multiple species
gttcacatatggtttgacaga

SEQ ID NO: 2064 - DNA, 21 bp, Unknown
  Found in multiple species
gtgggcgttcctgtgattaat

SEQ ID NO: 2065 - DNA, 21 bp, Unknown
  Found in multiple species
gtgattaatgttcacatatgg

SEQ ID NO: 2066 - DNA, 21 bp, Unknown
  Found in multiple species
gtgaacattaatcacaggaac

SEQ ID NO: 2067 - DNA, 21 bp, Unknown
  Found in multiple species
gtcaaaccatatgtgaacatt

SEQ ID NO: 2068 - DNA, 21 bp, Unknown
  Found in multiple species
gtattctttaattttctgtca

SEQ ID NO: 2069 - DNA, 21 bp, Unknown
  Found in multiple species
gtatgagatttccttccaagt

SEQ ID NO: 2070 - DNA, 21 bp, Unknown
  Found in multiple species
ggtttgacagaaaattaaaga

SEQ ID NO: 2071 - DNA, 21 bp, Unknown
  Found in multiple species
gggcgttcctgtgattaatgt

SEQ ID NO: 2072 - DNA, 21 bp, Unknown
  Found in multiple species
ggcgttcctgtgattaatgtt

SEQ ID NO: 2073 - DNA, 21 bp, Unknown
  Found in multiple species
ggaaggaaatctcatacttca

SEQ ID NO: 2074 - DNA, 21 bp, Unknown
  Found in multiple species
ggaaatctcatacttcaaaaa

SEQ ID NO: 2075 - DNA, 21 bp, Unknown
  Found in multiple species
gctttttgaagtatgagattt

SEQ ID NO: 2076 - DNA, 21 bp, Unknown
  Found in multiple species
gcgttcctgtgattaatgttc

SEQ ID NO: 2077 - DNA, 21 bp, Unknown
  Found in multiple species
gcacccgcggaggaatggatt

SEQ ID NO: 2078 - DNA, 21 bp, Unknown
  Found in multiple species
gattaatgttcacatatggtt

SEQ ID NO: 2079 - DNA, 21 bp, Unknown
  Found in multiple species
gatacttggaaggaaatctca

SEQ ID NO: 2080 - DNA, 21 bp, Unknown
  Found in multiple species
gaagtatgagatttccttcca

SEQ ID NO: 2081 - DNA, 21 bp, Unknown
  Found in multiple species
gaaggaaatctcatacttcaa

SEQ ID NO: 2082 - DNA, 21 bp, Unknown
  Found in multiple species
gaacattaatcacaggaacgc

SEQ ID NO: 2083 - DNA, 21 bp, Unknown
  Found in multiple species
gaaatctcatacttcaaaaag

SEQ ID NO: 2084 - DNA, 21 bp, Unknown
  Found in multiple species
gaaatccattcctccgcgggt

SEQ ID NO: 2085 - DNA, 21 bp, Unknown
  Found in multiple species
ctttttgaagtatgagatttc

SEQ ID NO: 2086 - DNA, 21 bp, Unknown
  Found in multiple species
ctttaattttctgtcaaacca

SEQ ID NO: 2087 - DNA, 21 bp, Unknown
  Found in multiple species
cttggaaggaaatctcatact

SEQ ID NO: 2088 - DNA, 21 bp, Unknown
  Found in multiple species
ctgtgattaatgttcacatat

SEQ ID NO: 2089 - DNA, 21 bp, Unknown
  Found in multiple species
ctgtcaaaccatatgtgaaca

SEQ ID NO: 2090 - DNA, 21 bp, Unknown
  Found in multiple species
ctcatacttcaaaaagcttga

SEQ ID NO: 2091 - DNA, 21 bp, Unknown
  Found in multiple species
cgttcctgtgattaatgttca

SEQ ID NO: 2092 - DNA, 21 bp, Unknown
  Found in multiple species
cctgtgattaatgttcacata

SEQ ID NO: 2093 - DNA, 21 bp, Unknown
  Found in multiple species
ccatatgtgaacattaatcac

SEQ ID NO: 2094 - DNA, 21 bp, Unknown
  Found in multiple species
cattaatcacaggaacgccca

SEQ ID NO: 2095 - DNA, 21 bp, Unknown
  Found in multiple species
catatgtgaacattaatcaca

SEQ ID NO: 2096 - DNA, 21 bp, Unknown
  Found in multiple species
catatggtttgacagaaaatt

SEQ ID NO: 2097 - DNA, 21 bp, Unknown
  Found in multiple species
cacccgcggaggaatggattt

SEQ ID NO: 2098 - DNA, 21 bp, Unknown
  Found in multiple species
cacatatggtttgacagaaaa

SEQ ID NO: 2099 - DNA, 21 bp, Unknown
  Found in multiple species
cacaggaacgcccactaattt

SEQ ID NO: 2100 - DNA, 21 bp, Unknown
  Found in multiple species
caagctttttgaagtatgaga

SEQ ID NO: 2101 - DNA, 21 bp, Unknown
  Found in multiple species
attttctgtcaaaccatatgt

SEQ ID NO: 2102 - DNA, 21 bp, Unknown
  Found in multiple species
attctttaattttctgtcaaa

SEQ ID NO: 2103 - DNA, 21 bp, Unknown
  Found in multiple species
attagtgggcgttcctgtgat

SEQ ID NO: 2104 - DNA, 21 bp, Unknown
  Found in multiple species
attaatcacaggaacgcccac

SEQ ID NO: 2105 - DNA, 21 bp, Unknown
  Found in multiple species
atgttcacatatggtttgaca

SEQ ID NO: 2106 - DNA, 21 bp, Unknown
  Found in multiple species
atgtgaacattaatcacagga

SEQ ID NO: 2107 - DNA, 21 bp, Unknown
  Found in multiple species
atggtttgacagaaaattaaa

SEQ ID NO: 2108 - DNA, 21 bp, Unknown
  Found in multiple species
atgagatttccttccaagtat

SEQ ID NO: 2109 - DNA, 21 bp, Unknown
  Found in multiple species
atctcatacttcaaaaagctt

SEQ ID NO: 2110 - DNA, 21 bp, Unknown
  Found in multiple species
atcacaggaacgcccactaat

SEQ ID NO: 2111 - DNA, 21 bp, Unknown
  Found in multiple species
atatgtgaacattaatcacag

SEQ ID NO: 2112 - DNA, 21 bp, Unknown
  Found in multiple species
atatggtttgacagaaaatta

SEQ ID NO: 2113 - DNA, 21 bp, Unknown
  Found in multiple species
atacttggaaggaaatctcat

SEQ ID NO: 2114 - DNA, 21 bp, Unknown
  Found in multiple species
agtgggcgttcctgtgattaa

SEQ ID NO: 2115 - DNA, 21 bp, Unknown
  Found in multiple species
agtatgagatttccttccaag

SEQ ID NO: 2116 - DNA, 21 bp, Unknown
  Found in multiple species
aggaaatctcatacttcaaaa

SEQ ID NO: 2117 - DNA, 21 bp, Unknown
  Found in multiple species
agctttttgaagtatgagatt

SEQ ID NO: 2118 - DNA, 21 bp, Unknown
  Found in multiple species
acttggaaggaaatctcatac

SEQ ID NO: 2119 - DNA, 21 bp, Unknown
  Found in multiple species
acccgcggaggaatggatttc

SEQ ID NO: 2120 - DNA, 21 bp, Unknown
  Found in multiple species
accatatgtgaacattaatca

SEQ ID NO: 2121 - DNA, 21 bp, Unknown
  Found in multiple species
acattaatcacaggaacgccc

SEQ ID NO: 2122 - DNA, 21 bp, Unknown
  Found in multiple species
acatatggtttgacagaaaat

SEQ ID NO: 2123 - DNA, 21 bp, Unknown
  Found in multiple species
aattttctgtcaaaccatatg

SEQ ID NO: 2124 - DNA, 21 bp, Unknown
  Found in multiple species
aattagtgggcgttcctgtga

SEQ ID NO: 2125 - DNA, 21 bp, Unknown
  Found in multiple species
aatgttcacatatggtttgac

SEQ ID NO: 2126 - DNA, 21 bp, Unknown
  Found in multiple species
aatctcatacttcaaaaagct

SEQ ID NO: 2127 - DNA, 21 bp, Unknown
  Found in multiple species
aatccattcctccgcgggtgc

SEQ ID NO: 2128 - DNA, 21 bp, Unknown
  Found in multiple species
aatcacaggaacgcccactaa

SEQ ID NO: 2129 - DNA, 21 bp, Unknown
  Found in multiple species
aagtatgagatttccttccaa

SEQ ID NO: 2130 - DNA, 21 bp, Unknown
  Found in multiple species
aaggaaatctcatacttcaaa

SEQ ID NO: 2131 - DNA, 21 bp, Unknown
  Found in multiple species
aagctttttgaagtatgagat

SEQ ID NO: 2132 - DNA, 21 bp, Unknown
  Found in multiple species
aaccatatgtgaacattaatc

SEQ ID NO: 2133 - DNA, 21 bp, Unknown
  Found in multiple species
aacattaatcacaggaacgcc

SEQ ID NO: 2134 - DNA, 21 bp, Unknown
  Found in multiple species
aaattagtgggcgttcctgtg

SEQ ID NO: 2135 - DNA, 21 bp, Unknown
  Found in multiple species
aaatctcatacttcaaaaagc

SEQ ID NO: 2136 - DNA, 21 bp, Unknown
  Found in multiple species
aaatccattcctccgcgggtg

SEQ ID NO: 2137 - RNA, 191 nt, Amaranthus palmeri
accgauuccugcaggagaaacaugguucuaagauggccuuccuagacggaaacccuccagagaggcugugcaugccuauuguuaaacacaucgagucacuagguggugaaguuaaacuuaacucucguauacaaaagauucaguuggaccagaguggaagcgugaagaguuuuuugcuaaauaacgggagg

SEQ ID NO: 2138 - DNA, 980 bp, Taraxacum officinale
cacataggattagactatagatgaaccaaacattaagcgatacgtttgacagaacatttttttaggttttttggttaataaacaaacaaatatgaacataattttttgtttgtttagttaaacaattaaaaatatttgtgaagtccacacacataggattaggtttgtaaatgaacaaaatatttagggaaacgtttgacatttttttttaatgtttgtttaattataaacaaacaaacatgaatatgattttttatttgtttatttaacaaaacaaaacatagaacaaaataaatccaatttgtgatgcatatgcggatacaaatatgaacatggcaaatcatatgcacatataaatgttttcttgactatatattgttaatttccgtccaaaataaaaaaattggtattattttttggaataatagtatataataaaaacttcttattttaatattcgttttcatttagtttttgttttgcatttaaatcgaaaagttgtttaagagttgttaattgagtcagatctaacttagtgacctaatgaacaaaatttgtactattggttgtcattatagatcattttctctaaaaacatctgaaaggaatcatggtatggaatcatgacagtcagaaaattctaagtttgatatcacatggtctaaatcttatcgatgatgtaataccaaactcaacaagagactcttatcagatagcccttaacattgcatttataatatatgtttataaaaagtaacatggaatatatgtacaaatacacaaatttataatcacattgcggacatttgatccgataacatagaaaaataatgatatttgtttttttagttataaaaaatgtttttaaagtgttagttgcagtttagccggagggaggagtgaggacggtatattcctaacaatggatgacgaagttccaacaacgaaagaagccaaaaacaatcccaaaattgaaagcc

SEQ ID NO: 2139 - DNA, 19 bp, Taraxacum officinale
agataaaaccgcgccttcc

SEQ ID NO: 2140 - DNA, 25 bp, Taraxacum officinale
ccgcgccttccattgaagccaaata

SEQ ID NO: 2141 - DNA, 24 bp, Taraxacum officinale
tacttttgcttggtataatcaccc

SEQ ID NO: 2142 - DNA, 24 bp, Taraxacum officinale
  unsure (1)..(24): unsure at all n locations
gataaataaaacccntgaatgggc

SEQ ID NO: 2143 - DNA, 23 bp, Taraxacum officinale
acagacctcggcgttttaacaac

SEQ ID NO: 2144 - DNA, 22 bp, Taraxacum officinale
tttgatccggtgaaatctcatc

SEQ ID NO: 2145 - DNA, 22 bp, Taraxacum officinale
ttttaaaggggagacgttcttc

SEQ ID NO: 2146 - DNA, 24 bp, Taraxacum officinale
gatcttggtgtaaaagaacgggcg

SEQ ID NO: 2147 - DNA, 23 bp, Taraxacum officinale
gcggttgggaattgcaatcggtg

SEQ ID NO: 2148 - DNA, 22 bp, Taraxacum officinale
atggcatcgcaatatccaaatg

SEQ ID NO: 2149 - DNA, 23 bp, Taraxacum officinale
gcgtgaaacaatctcttgaaggg

SEQ ID NO: 2150 - DNA, 22 bp, Taraxacum officinale
ttcattactgtgcactttccac

SEQ ID NO: 2151 - DNA, 160 bp, Taraxacum officinale
gtctaaatcttatcgatgatgtaataccaaactcaacaagagactcttatcagatagcccttaacattgcatttataatatatgtttataaaaagtaacatggaatatatgtacaaatacacaaatttataatcacattgcggacatttgatccgataac

SEQ ID NO: 2152 - DNA, 158 bp, Taraxacum officinale
gaaaaataatgatatttgtttttttagttataaaaaatgtttttaaagtgttagttgcagtttagccggagggaggagtgaggacggtatattcctaacaatggatgacgaagttccaacaacgaaagaagccaaaaacaatcccaaaattgaaagcc

SEQ ID NO: 2153 - DNA, 21 bp, Taraxacum officinale
taaacaattaaaaatatttgt

SEQ ID NO: 2154 - DNA, 21 bp, Taraxacum officinale
ataggattaggtttgtaaatg

SEQ ID NO: 2155 - DNA, 21 bp, Taraxacum officinale
gtttgtttaattataaacaaa

SEQ ID NO: 2156 - DNA, 21 bp, Taraxacum officinale
gtttatttaacaaaacaaaac

SEQ ID NO: 2157 - DNA, 21 bp, Taraxacum officinale
catatgcggatacaaatatga

SEQ ID NO: 2158 - DNA, 21 bp, Taraxacum officinale
atcatatgcacatataaatgt

SEQ ID NO: 2159 - DNA, 21 bp, Taraxacum officinale
attgttaatttccgtccaaaa

SEQ ID NO: 2160 - DNA, 21 bp, Taraxacum officinale
ataaaaaaattggtattattt

SEQ ID NO: 2161 - DNA, 21 bp, Taraxacum officinale
gttgttaattgagtcagatct

SEQ ID NO: 2162 - DNA, 21 bp, Taraxacum officinale
gatctaacttagtgacctaat

SEQ ID NO: 2163 - DNA, 21 bp, Taraxacum officinale
tatagatcattttctctaaaa

SEQ ID NO: 2164 - DNA, 21 bp, Taraxacum officinale
aaaacatctgaaaggaatcat

SEQ ID NO: 2165 - DNA, 21 bp, Taraxacum officinale
tgaaaggaatcatggtatgga

SEQ ID NO: 2166 - DNA, 21 bp, Taraxacum officinale
aatcatgacagtcagaaaatt

SEQ ID NO: 2167 - DNA, 21 bp, Taraxacum officinale
cacatggtctaaatcttatcg

SEQ ID NO: 2168 - DNA, 21 bp, Taraxacum officinale
taccaaactcaacaagagact

SEQ ID NO: 2169 - DNA, 21 bp, Taraxacum officinale
cagatagcccttaacattgca

SEQ ID NO: 2170 - DNA, 21 bp, Taraxacum officinale
atttataatatatgtttataa

SEQ ID NO: 2171 - DNA, 21 bp, Taraxacum officinale
aaaagtaacatggaatatatg

SEQ ID NO: 2172 - DNA, 21 bp, Taraxacum officinale
atttataatcacattgcggac

SEQ ID NO: 2173 - DNA, 21 bp, Taraxacum officinale
gcggacatttgatccgataac

SEQ ID NO: 2174 - DNA, 21 bp, Taraxacum officinale
gtgttagttgcagtttagccg

SEQ ID NO: 2175 - DNA, 21 bp, Taraxacum officinale
ggagggaggagtgaggacggt

SEQ ID NO: 2176 - DNA, 21 bp, Taraxacum officinale
cggtatattcctaacaatgga

We claim:

1. A method of plant control comprising:
    topically applying to a surface of a plant a composition comprising a non-transcribable polynucleotide and a transfer agent,
        wherein said non-transcribable polynucleotide is from 21 to about 700 nucleotides in length and comprises a nucleotide sequence identical or complementary to at least 21 contiguous nucleotides of a phytoene desaturase (PDS) gene sequence or an RNA sequence thereof selected from the group consisting of SEQ ID NOs: 13, 15, 24, 35, 37, 41, 43-46, 50-56, 58-60, 64, 70-72, 74-80, 89-92, 123, 124, 165-170, 173-178, 185-194, 199-202, 207-212, 223-234, 241-248, 251, 252, 255-258, 265-270, 275-280, 305-310, 313-332, 337-342, 353-364, 367-370, 377-380, 391-404, 411-424, 427, 428, 437-442, 445-518, 521-526, 533-536, 547, 548, 551-554, 561-570, 575, 576, 583-596, 601, 602, 609-614, 619-626, 643, 644, 669-674, 681, 682, 719-722, 727-730, 733-748, 753-756, 759-762, 769, 770, 775-778, 781-784, 787-792, 797, 798, 801, 802, 811-814, 823-842, 845, 846, 851, 852, 855, 856, 861-868, 871-876, 885, 886, 893-1004, 1015, 1016, 1021-1042, 1045, 1046, 1049-1070, 1073, 1074, 1081, 1082, 1085-1092, 1097-1104, 1109-1230, 1233, 1234, 1237-1258, 1261, 1262, 1269, 1270, 1273-1282, 1285-1294, 1297-1310, 1313-1328, 1331-1334, 1337-1340, 1343-1398, 1403-1408, 1413-1460, 1463-1476, 1479-1536, 1539-1560, 1565-1576, 1579-1606, 1609-1634, 1637-1640, 1643, 1644, 1647-1652, 1655-1670, 1675-1678, 1681-1684, 1689-1756, 1759-

1784, 1787-1790, 1797-1800, 1803-1820, 1823-1828, 1831, 1832, 1837-1856, 1859-1862, 1867, 1868, 1871, 1872, 1881-1884, 1893, 1894, 1901-1974, 1977-1984, 1987-1990, 1993-2010, 2048, 2052, 2075, 2083, 2085, 2090, 2100, 2109, 2117, 2126, 2131, 2135, and 2138-2176, wherein said transfer agent is a surfactant and conditions said surface of said plant for permeation by said non-transcribable polynucleotide, whereby said plant's growth, development, or reproductive ability is suppressed or delayed or said plant is more sensitive to a PDS inhibitor herbicide, relative to an untreated plant.

2. The method as claimed in claim 1, wherein said transfer agent comprises an organosilicone surfactant composition or an organosilicone compound contained therein.

3. The method as claimed in claim 1, wherein said non-transcribable polynucleotide is selected from the group consisting of a sense single-stranded DNA (ssDNA), an anti-sense ssDNA, a sense single-stranded RNA (ssRNA), an anti-sense ssRNA, a double-stranded RNA (dsRNA), a double-stranded DNA (dsDNA), and a dsDNA/RNA hybrid.

4. The method as claimed in claim 1, wherein said plant is selected from the group consisting of *Abutilon theophrasti, Amaranthus chlorostachys, Amaranthus graecizans, Amaranthus palmeri, Amaranthus rudis, Amaranthus hybridus, Amaranthus lividus, Amaranthus spinosus, Amaranthus viridis, Ambrosia artemisiifolia, Ambrosia trifida, Commelina diffusa, Conyza canadensis, Digitaria sanguinalis, Euphorbia heterophylla, Kochia scoparia, Lolium multiflorum, Taraxacum officinale,* and *Lactuca serriola.*

5. The method as claimed in claim 1, wherein said composition further comprises said PDS inhibitor herbicide.

6. The method as claimed in claim 5, wherein said composition further comprises one or more co-herbicides similar to or different from said PDS inhibitor herbicide.

7. The method as claimed in claim 1, wherein said composition comprises any combination of two or more of said non-transcribable polynucleotides.

8. A composition for topical application to a surface of a plant comprising a non-transcribable polynucleotide and a transfer agent, wherein said non-transcribable polynucleotide is from 21 to about 700 nucleotides in length and comprises a nucleotide sequence identical or complementary to at least 21 contiguous nucleotides of a phytoene desaturase (PDS) gene sequence or an RNA sequence thereof selected from the group consisting of SEQ ID NOs: 13, 15, 24, 35, 37, 41, 43-46, 50-56, 58-60, 64, 70-72, 74-80, 89-92, 123, 124, 165-170, 173-178, 185-194, 199-202, 207-212, 223-234, 241-248, 251, 252, 255-258, 265-270, 275-280, 305-310, 313-332, 337-342, 353-364, 367-370, 377-380, 391-404, 411-424, 427, 428, 437-442, 445-518, 521-526, 533-536, 547, 548, 551-554, 561-570, 575, 576, 583-596, 601, 602, 609-614, 619-626, 643, 644, 669-674, 681, 682, 719-722, 727-730, 733-748, 753-756, 759-762, 769, 770, 775-778, 781-784, 787-792, 797, 798, 801, 802, 811-814, 823-842, 845, 846, 851, 852, 855, 856, 861-868, 871-876, 885, 886, 893-1004, 1015, 1016, 1021-1042, 1045, 1046, 1049-1070, 1073, 1074, 1081, 1082, 1085-1092, 1097-1104, 1109-1230, 1233, 1234, 1237-1258, 1261, 1262, 1269, 1270, 1273-1282, 1285-1294, 1297-1310, 1313-1328, 1331-1334, 1337-1340, 1343-1398, 1403-1408, 1413-1460, 1463-1476, 1479-1536, 1539-1560, 1565-1576, 1579-1606, 1609-1634, 1637-1640, 1643, 1644, 1647-1652, 1655-1670, 1675-1678, 1681-1684, 1689-1756, 1759-1784, 1787-1790, 1797-1800, 1803-1820, 1823-1828, 1831, 1832, 1837-1856, 1859-1862, 1867, 1868, 1871, 1872, 1881-1884, 1893, 1894, 1901-1974, 1977-1984, 1987-1990, 1993-2010, 2048, 2052, 2075, 2083, 2085, 2090, 2100, 2109, 2117, 2126, 2131, 2135, and 2138-2176, wherein said transfer agent is a surfactant and conditions said surface of said plant for permeation by said non-transcribable polynucleotide, and whereby said plant treated with said composition has its growth, development, or reproductive ability suppressed or delayed or said plant is more sensitive to a PDS inhibitor herbicide, relative to an untreated plant.

9. The composition of claim 8, wherein said transfer agent is an organosilicone composition or an organosilicone compound contained therein.

10. The composition of claim 8, wherein said non-transcribable polynucleotide is selected from the group consisting of SEQ ID NOs: 24, 79, 80, 89-92, 123, 124, 185-194, 199-202, 207-212, 223-234, 241-246, 265, 266, 269, 270, 275-280, 305-310, 313-318, 323-332, 337-342, 355-362, 367-370, 377-380, 391-404, 411-418, 441, 442, 445-454, 515-518, 521-526, 533-536, 547, 548, 551-554, 609-614, 619-626, 643, 644, 669-672, 681, 682, 719-722, 727-730, 733-736, 747, 748, 753-756, 759-762, 769, 770, 775-778, 781-784, 787, 788, 801, 802, 873-876, 885, 886, 893-896, 907, 908, 999-1004, 1015, 1016, 1021-1024, 1279, 1280, 1473-1476, 1483-1494, 1981-1984, 1987-1990, 1993, and 1994.

11. The composition of claim 8, wherein said non-transcribable polynucleotide is selected from the group consisting of SEQ ID NOs: 2048, 2052, 2075, 2083, 2085, 2090, 2100, 2109, 2117, 2126, 2131, and 2135.

12. The composition of claim 8, further comprising a PDS inhibitor herbicide.

13. The composition of claim 12, wherein said PDS inhibitor herbicide is selected from the group consisting of pyridazinones, pyridinecarboxamides, beflubutamid, fluridone, flurochloridone, and flurtamone.

14. The composition of claim 12, further comprising a co-herbicide.

15. An agricultural chemical composition for topical application to a surface of a plant comprising a non-transcribable polynucleotide, a phytoene desaturase (PDS inhibitor herbicide, a transfer agent, and a co-herbicide, wherein said non-transcribable polynucleotide is from 21 to about 700 nucleotides in length and comprises a nucleotide sequence identical or complementary to at least 21 contiguous nucleotides of a PDS gene sequence or an RNA sequence thereof selected from the group consisting of SEQ ID NOs: 13, 15, 24, 15, 37, 41, 43-46, 50-56, 58-60, 64, 70-72, 74-80, 89-92, 123, 124, 165-170, 173-178, 185-194, 199-202, 207-212, 223-234, 241-248, 251, 252, 255-258, 265-270, 275-280, 305-310, 313-332, 337-342, 353-364, 367-370, 377-380, 391-404, 411-424, 427, 428, 437-442, 445-518, 521-526, 533-536, 547, 548, 551-554, 561-570, 575, 576, 583-596, 601, 602, 609-614, 619-626, 643, 644, 669-674, 681, 682, 719-722, 727-730, 733-748, 753-756, 759-762, 769, 770, 775-778, 781-784, 787-792, 797, 798, 801, 802, 811-814, 823-842, 845, 846, 851, 852, 855, 856, 861-868, 871-876, 885, 886, 893-1004, 1015, 1016, 1021-1042, 1045, 1046, 1049-1070, 1073, 1074, 1081, 1082, 1085-1092, 1097-1104, 1109-1230, 1233, 1234, 1237-1258, 1261, 1262, 1269, 1270, 1273-1282, 1285-1294, 1297-1310, 1313-1328, 1331-1334, 1337-1340, 1343-1398, 1403-1408, 1413-1460, 1463-

1476, 1479-1536, 1539-1560, 1565-1576, 1579-1606, 1609-1634, 1637-1640, 1643, 1644, 1647-1652, 1655-1670, 1675-1678, 1681-1684, 1689-1756, 1759-1784, 1787-1790, 1797-1800, 1803-1820, 1823-1828, 1831, 1832, 1837-1856, 1859-1862, 1867, 1868, 1871, 1872, 1881-1884, 1893, 1894, 1901-1974, 1977-1984, 1987-1990, 1993-2010, 2048, 2052, 2075, 2083, 2085, 2090, 2100, 2109, 2117, 2126, 2131, 2135, and 2138-2176, wherein said transfer agent is a surfactant and conditions said surface of said plant for permeation by said non-transcribable polynucleotide, and whereby said plant treated with said composition has its growth, development, or reproductive ability suppressed or delayed or said plant is more sensitive to said PDS inhibitor herbicide, relative to an untreated plant.

16. The agricultural chemical composition of claim 15, wherein said co-herbicide is selected from the group consisting of amide herbicides, arsenical herbicides, benzothiazole herbicides, benzoylcyclohexanedione herbicides, benzofuranyl alkylsulfonate herbicides, cyclohexene oxime herbicides, cyclopropylisoxazole herbicides, dicarboximide herbicides, dinitroaniline herbicides, dinitrophenol herbicides, diphenyl ether herbicides, dithiocarbamate herbicides, glycine herbicides, halogenated aliphatic herbicides, imidazolinone herbicides, inorganic herbicides, nitrile herbicides, organophosphorus herbicides, oxadiazolone herbicides, oxazole herbicides, phenoxy herbicides, phenylenediamine herbicides, pyrazole herbicides, pyridazine herbicides, pyridazinone herbicides, pyridine herbicides, pyrimidinediamine herbicides, pyrimidinyloxybenzylamine herbicides, quaternary ammonium herbicides, thiocarbamate herbicides, thiocarbonate herbicides, thiourea herbicides, triazine herbicides, triazinone herbicides, triazole herbicides, triazolone herbicides, triazolopyrimidine herbicides, uracil herbicides, and urea herbicides.

17. An agricultural chemical composition for topical application to a surface of a plant comprising a non-transcribable polynucleotide, a phytoene desaturase (PDS) inhibitor herbicide, a transfer agent, and a pesticide, wherein said non-transcribable polynucleotide is from 21 to about 700 nucleotides in length and comprises a nucleotide sequence identical or complementary to at least 21 contiguous nucleotides of a PDS gene sequence or an RNA sequence thereof selected from the group consisting of SEQ ID NOs: 13, 15, 24, 35, 37, 41, 43-46, 50-56, 58-60, 64, 70-72, 74-80, 89-92, 123, 124, 165-170, 173-178, 185-194, 199-202, 207-212, 223-234, 241-248, 251, 252, 255-258, 265-270, 275-280, 305-310, 313-332, 337-342, 353-364, 367-370, 377-380, 391-404, 411-424, 427, 428, 437-442, 445-518, 521-526, 533-536, 547, 548, 551-554, 561-570, 575, 576, 583-596, 601, 602, 609-614, 619-626, 643, 644, 669-674, 681, 682, 719-722, 727-730, 733-748, 753-756, 759-762, 769, 770, 775-778, 781-784, 787-792, 797, 798, 801, 802, 811-814, 823-842, 845, 846, 851, 852, 855, 856, 861-868, 871-876, 885, 886, 893-1004, 1015, 1016, 1021-1042, 1045, 1046, 1049-1070, 1073, 1074, 1081, 1082, 1085-1092, 1097-1104, 1109-1230, 1233, 1234, 1237-1258, 1261, 1262, 1269, 1270, 1273-1282, 1285-1294, 1297-1310, 1313-1328, 1331-1334, 1337-1340, 1343-1398, 1403-1408, 1413-1460, 1463-1476, 1479-1536, 1539-1560, 1565-1576, 1579-1606, 1609-1634, 1637-1640, 1643, 1644, 1647-1652, 1655-1670, 1675-1678, 1681-1684, 1689-1756, 1759-1784, 1787-1790, 1797-1800, 1803-1820, 1823-1828, 1831, 1832, 1837-1856, 1859-1862, 1867, 1868, 1871, 1872, 1881-1884, 1893, 1894, 1901-1974, 1977-1984, 1987-1990, 1993-2010, 2048, 2052, 2075, 2083, 2085, 2090, 2100, 2109, 2117, 2126, 2131, 2135, and 2138-2176, wherein said transfer agent is a surfactant and conditions said surface of said plant for permeation by said non-transcribable polynucleotide, and whereby said plant treated with said composition has its growth, development, or reproductive ability suppressed or delayed or said plant is more sensitive to said PDS inhibitor herbicide, relative to an untreated plant.

18. The agricultural chemical composition of claim 17, wherein said pesticide is selected from the group consisting of insecticides, fungicides, nematicides, bactericides, acaricides, growth regulators, chemosterilants, semiochemicals, repellents, attractants, pheromones, feeding stimulants, and biopesticides.

19. A herbicide composition for topical application to a surface of a plant comprising a phytoene desaturase (PDS), inhibitor herbicide, a non-transcribable polynucleotide, and a transfer agent, wherein said non-transcribable polynucleotide comprises a nucleotide sequence identical or complementary to at least 21 contiguous nucleotides of a sequence selected from the group consisting of SEQ ID NOs: 2139-2176, wherein said transfer agent is a surfactant and conditions said surface of said plant for permeation by said non-transcribable polynucleotide, and whereby said plant treated with said herbicide composition has its growth, development, or reproductive ability suppressed or delayed or said plant is more sensitive to said PDS inhibitor herbicide, relative to an untreated plant.

20. The composition of claim 1, wherein said non-transcribable polynucleotide is an RNA polynucleotide.

21. The method of claim 8, wherein said non-transcribable polynucleotide is an RNA polynucleotide.

* * * * *